United States Patent 8,299,233 (MOLECULAR IN VITRO DIAGNOSIS OF BREAST CANCER) - sequence listing, part 2

SEQ ID NO: 5589 - DNA, 3125 bp, Homo sapiens
gcccagttggagccagacagcggggtggacaagtggcgtgtgtgctgcgaccccgagggaagatgaacgggacgcggaactggtgtaccctggtggacgtgcacccagaggaccaggcggcgggcagcgtggacattctcaggctgactctccagggtgaactgacaggagatgaacttgaacacatagcccagaaggcgggcaggaagacctatgccatggtgtccagccactcagctggtcattctctggcttcagaactggtggagtcccatgatggacatgaggagatcattaaggtgtacttgaaggggaggtctggagacaagatgattcacgagaagaatattaaccagctgaagagtgaggtccagtacatccaggaggccaggaactgcctacagaagctccgggaggatataagtagcaagcttgacaggaacctaggagattctctccatcgacaggagatacaggtggtgctagaaaagccaaatggctttagtcagagtcccacagccctgtacagcagcccacctgaggtggacacctgtataaatgaggatgttgagagcttgaggaagacggtgcaggacttgctggccaagcttcaggaggccaagcggcaacaccagtcagactgtgtggcttttgaggtcacactcagccggtaccagagggaagcagaacaaagtaatgtggcccttcagagagaggaggacagagtggagcagaaagaggcagaagtcggagagctgcagaggcgcttgctagggatggagacggagcatcaggccttactggcgaaagtgagggaaggggaggtggccctagaggaacttcggagcaacaatgctgactgccaagcagaacgagaaaaggctgctaccctggaaaaggaagtggccgggttgcgggagaagatccaccacttggatgacatgctcaagagccagcagcggaaagtccggcaaatgatagagcagctccagaattcaaaagctgtgatccagtcaaaggacgccaccatccaggagctcaaggagaaaatcgcctatctggaggcagagaatttagagatgcatgaccggatggaacacctgatagaaaaacaaatcagtcatggcaacttcagcacccaggcccgggccaagacagagaacccgggcagtattaggatatccaagccgcctagcccgaagcccatgcctgtcatccgagtggtggaaacctgagctgcctggagatggttgctgccattgctgctgcctctgcctcggagaagcccactgcccctgttggctgttaacactgcctttgacttcctgactgtcccctggctgcacccaggacttcgggctcctgtgtctcaccattcccaagcccctggccactctaagctgggcagacggagcacgagcacctattcaaggcactgcagccctttggaagacattgtcctgcaagcaggagccagggcaatatctatattcctacagtgactatttttctctgtagagagcctcccttctgttgtagactggactctggctgcgccataagccaggccttcatcagattgggagaggtgacaagatttgcctcagccctaaaagctggagacacagatgtccagagtgattggagaatgtcctgggggaatgaagttccttccacaaacacagctcagttcttagcaacaaactgtttgtttttctacttgctccatctgcagcctacgctgccctggcctcctgcagacagatagtggggttacctggcaaggcctggtgagagccagtgaacctaagctttgactgggtggccttgtctttctggggaggagggaatgtacattcagggagtagccttttgcggaaaaattctctagggctacagacagtcatgtgtgacttctctctgctgtgaaaactcccagagtctctttagggattttccctaaggtgtaccaccaggcacacctcagtcttcttgacccagagcctgaaaactgttttcactgggttccaccagtcccagcaaaatcctctttgtatttattttgctaagttattggtggttttgcttacatctcatgattgatataataccaaagttctatagccttctcttgcagtatttggatttgcttgaaaccgggaaaactgttcccattaggcttgttaatgtcagagtgacactattatgaatctttctctccctttcctctgcctgtttcttctctctttctccttcaaacttgctctgcagctaaggaaggtgagtctactttccctgaggctttggggtcagagtatatgttgtttggagaaagagggcaatcaggactcttctgggacccagatgagttcttcactagcccttctgaaccccttgctccataattggtcttttatcctggctctgaatgaccctgcaggtcatcatggttttctttttttattgtttttttttttctgagacagagtctcactctgtcacccaggctggagtgcagtagcgcgatctcagctcactgcaacctctgcctcccggatttaagcgattcttctgcctcagcctcccgagtagctgggactacaggtgtgccaccacgcctggctgatttttgtatttttagtagagatggggtttcaccatactggctaggctggtctcgaattcctgacctcaggtgatccacccacctcggcttcccaaagtgctaggattataggcttgagctactgtgcccggcccatggtgtttttctttagggctcttcctacagccttgagaagtagataggcatcagagtatggtactataggaatcagaaaaattcaaaacaaatgtggattaagtgtttaggctctatgtggctcacgcagccagaatccttaagtctgtgtgtttctgtgtctcaagactgggctcacattctggctttgtccataacaatgctctgggatttcagggagttccctcatttgtaaaatgagggggtcagagcaggtgatatccatgtttcttccctttctgatattgttgtctgtggcatattctttgtatggcgaatttaataaattatattaatgtgtctctttgaaaaaaaaaaaaaaaaa

SEQ ID NO: 5590 - DNA, 7136 bp, Homo sapiens
gcttatattttttccagctcccaaattccctttattccactttagtcccttcattttcagagatgaggaaacagattgctttgttcaaagacagctagaactagaacacaggctaatacttgctagccatgtgatatactaatgtcagccaaatacgggcatttacactttcagatgtttgccatatctgtgcacttactaattctgtttaatacaatttaaattgactcctttaaataagcttattttaaaggaaattttttgctactataaatagaaaaccattatatcctttaaatagtaactctaaataggaattcaaaacaaagcaacgttattaaaatttaatttaaaattaatttaaatttaattgttattaaatttttaattattgctgttcttcgtcagaaatgtgtcaaagcattgttttcatgtttgatgtcagttccttaattgtctaaacagaaaaagcacagctaatgcctctagttaagcttctgtataacttttttaaatgaaatgcttcttagaggggaaatgagagggcatgaatacatgtttatatactaaagtatgatttcatgtatatcagaagatcttattatatggaaccaaaattattctttggttgatttaattgttcttgaaacttcagtttttaccttgaaggttttagttagcttagcataagtttatttttctaaataaggaatctgattgcctcacaactcagatgtatcacagttatggtgaaatagcaatatattggtttctgtaaccttttaaataccgtaatgaattaaaatctcttcagcaaaagcaaatatatctagggtgacgagaggtgtttttagtgtatttgaatgatggaaatgtttttcttaaaatatttctgaagcattttttaaaataattttttgaatttattgatgatagtagttgtgtgttagtgtgaatgactggtctaaatgtgtatgtcacttccaagggattagtaggggtcagaatgatttgttttattcattgacttttcctttgacgtgttcttattcattgggctacatacattccctgttgccttctcaccaaaagtgccactacacaggctgtatttcattgtactgtagaaaaagacaagtagacctttttcattcatgagattcctatgaaatctgttggtggaggtataaaatgaggagacttttatgggctagctagtaggagttttgctgtgaaacctttgtaacaggtctatcaggaactagggagagaaataaatgcaggaaatacttgatcccattaaactgaggatgaaaaagacatgataatattttggggattatttattgtgtgattttccggctgatcagaagtgttaattttttgttatacttgtgtcaaatacatatatatatatatattttgaaatggagtcttgctctgtcacccaggctggagtgcagtggtgcgatctgggttcactgcaacctctgcctccaggttcaagtgatcctcctgcctcagcctcccgagtagctaggactacaggcacgtgccaccacgccctgctaatttttgtattcttagtggagatggggtttcaccatgttggccaggctggtcttgaactcctgacctcaagtgatcttcccaccttggcctttctgaactatttcctttacacacatttagaactacatctaactgtattatagttttcactttcaccatcagacaaaattcagaagattcaagagaaggaaagtcgattgtatttactcatatttttgctaccgtgtttttacatctcatattttaaggctctcttaattatttattttctgtttagttaatttcctctagccattctttatttatagtgggtctgctggtaacaaattctctcaatttttcctcgtctgagaatgtcttgacttcccttccatttttgtcagcacctgaaaaatactatgccactatcttctgggttctgtggtttctgatgagaactccactgtcagtctaattgtcgttataaatgcagtgttctctctctctctctgcttccaggatattttttcttttttttttttttttttttcttgagacggagtctcactctgtcgcccaggctggagtgcagtggcgcaattttggctcactgcaagctctgcctcccgggttcaagcgattactcccactttagcctcccaagtagctaggactacaaggcacaccaccatgcctggctaatttttgtatttttagtagagacggggtttcaccatgttgcccaggctggtctcgaactcctgacatcaagtgatcttcctgcctccgcttcccaaagtgctggaattacaggcgtgagccactgctcccagcctctttattttttcagctttactctttcttctgtctttttgacatgtgtgtccagtgacacacgtgttagattttgctatagtctcacgcacgggtctataaggctctgttttttgtttcattttgtttttcctattttctctctattcagatcgagtaatttccactgttcagttttatcatagctgcttttaaatctttgtcaggtaattctgtcatctaagttttggcacctattgattatcttttgcattgtttttgtttttgtttctgtttttgttttgagatggagtcttgctctgttgcccaggttggagtgcagtggcactgatctcggctcactgcaacctcctcctcccgggttcaagtggttctcctgcctcaacctccttagtagctgggattacaggcatgtgccaccacgcccggctaattttgtatttttagtagagaccaggtttatccatgttggtcaggctggtctcaaactcccaacctcaagtgatccgcctgcctcgacctcccaaagtgctgggattacaggcgtgaaccactgcacccagcctatcttttgcattgttttaaatcttgttcttgctaggatgaatgattttctgttaaaactagatattttcatattatgttcctaggctctggatattatctaaaccttctgtttccactggcttttattgacactgctttggcaaggtcatagggggtgcctcattactgccaggtggacatagaagtcaagggtccctactcagcctctactgatgcctcaggaagaggatccttcttgttattgctgggtgggggtggaagtctagctgacacctactgaggtaggtgctggggcatgcccggccatcagggtgaaagtcctggctccctagttggcctacttttacattgccctaatagggcattggagctcctcactatggtttatgagctggaagtcaaggctcctcacttagctttcgttggtgtgggtggtggtggggcaaaactgttttctgggtttggctggagtggagcagttactgtcaaaagttttctgtcttgccaggctgtccctttcttgtttctttggctagagagagcaagcttttgttgtggctctttttgtctgtgccagttggcatttccaggttgctgccttctttagctccaagtctgggatatattaggcaaaaagaaaacccagagaatttacaccaccgtgtcattccatgggtcctgaggtcccttacttagtctgccttctctccacttttcacagtcttctcatgttttgtatataatgtccagggtctttagttatacttagcagaaataaaagggaaaagtatgtctgctctatgcttctgtaagtggaagtcttcaaatttgcatttttgattcctttaaacagttttgtaaaatatataatcattattgggcaaaatgtcccataaaatgtatataccttgtgatggtttgcataatattgtgttcaagaggactgctgaaaaataacatctttatttaaactgaaacgaattgttcacattattaatgaaaacttttcccctctaggaaataatgcaaaaggtgtcccaaggctcctgaccagtgaacaaagatttgagaaagacagccaagctcatgttttctcctgatcaagaaaatcatccatctaaagcaccagtaaaatatggtgaactcattgtcttaggctataatgggtctctcccaaatggcgatagaggaaggaggaaaagtaggtttgctttgtttaaaagacctaaggcaaatggggtgaagcccagcactgtgcatattgcttgtactcctcaggctgcaaaggcaataagcaacaaagaccagcatagcatatcatatactttgtctcgggcccagactgtggtggttgaatatactcatgacagcaacacagatatgtttcagattggccggtcgactgaaagccccattgattttgtagtaactgacacggttcctggaagtcaaagtaattctgatacacagtcagtacaaagcactatatcaagatttgcctgcagaatcatatgtgaacggaatcctccctttacagcacggatttatgctgcaggatttgactcatcaaaaaacatctttcttggggagaaggctgccaaatggaagacatcagatggacagatggatggcttgaccactaatggtgttcttgtgatgcatccacgcaatgggttcacagaagactccaagcctggaatatggagagaaatatcggtgtgtggaaatgtatttagcctacgtgaaaccagatcggctcagcagagaggaaaaatggtggaaattgaaaccaatcagttacaagatggctcgttaattgacctctgtggtgcaacattgttatggcgtactgcagaaggcctttcccacactcctaccgtgaagcatttagaagctttaagacaggaaatcaatgcagcacgacctcagtgccctgtagggttcaacacactagcatttcctagtatgaagaggaaagacgttgtagatgaaaaacaaccatgggtatatctaaactgcggccatgtacatggctatcataactggggaaacaaagaagaacgtgatggaaaagatcgtgaatgtcctatgtgtaggtctgttggtccctatgttcctctgtggcttggatgtgaagctggattttatgtggacgccggccctccaacccatgcgtttagcccgtgtgggcatgtgtgttcagaaaagacaactgcctattggtcccagatcccacttcctcatggtactcatacttttcatgcagcctgtcccttttgtgcacatcagttggctggtgaacaaggctacatcagacttatttttcaaggacctctagactaacagaccattgtcttgcaggactacattataaatttataagctaagtgagttgggttttcgaacctgttgtccacgtcacagtttttctgctctggtcatttgcattaagatgaagaattttttaaaacatttataataaatagtagcaatttctgagcaaaaatctgggaaactcaagcaaaggaatttctgaaagtatcagtcttctgaattctgagttttgaaaatatattttgaggagaaaaagacatagtctaatttgatgccttccttttagtgtttttgaatcacctatcctcagtgctgaaattgttttgtataactgagggtactgttggttcaaactatgttagtttacagtttgttgcaaacattgtaaaatacagcgacatgtatattaacttttttctatttatctttattatagaaaataccttagaatgttcttgatagagtagcatggtaacgatggtgtcacacccttggtgtgaatggtagcttagtgagcaacctagctcaaggatttgcaaagttaggaagaaggacgagagagcctctctccccaccccaatctaaatatggaatttggtaaattagaatactttgtaatttgtaagaccaaattcatactaattacccgcgtgaaaggtgtttgtttttaacaacattgaagataatcaggaaagattttttcttaatgtttctctcgagcgtagtactataacaaaaacttaatgctaagaaacattttatatgctcctttggatatgcaatttaatctagattatctatttttctcccatgataactaatctgtttttagtatcagcagcatttggcaagtttattttttggatataaactgtggttcatctgttcactgtttctagaaaaaaatcattgccataagaaaaagtataaattagcaagaaaggagagtgacttgatttgcttttggaaaaagaaatgcttaattaattattctgtatttggccttattcgggcattaggaaatctagagatctaaagggttgaatgacaatagtgcccccgtttttagcagaccagccttaactctgggtttgaatcctaaggagattgccacagtgagacttaaggaaatgtttggttggcagatgagcaccaatgactgcagcgtggagtgacgcactgcatggtctgtttattctctaattccaatatgtcttttgcttccagaagcaagaaaagtttcttctctcccctccttcccacccttttttcaaaggcaccacaagtatagacagttgcactacatcaaatctttttttgacacttgtagaaaccagtacacttttagattagacagtatcttcttttaatattttgatttgttttcctttagtttgaaaagttgtataatacttaactgactgtagcaaagttttatatgtggtagcatacctttaatttatcctattacaaaactgttctgaattttcttttggtttttaaaaaacaaaacttgttgcttagaagccatgaattattttattttacttcaactgtcgaaacttccttgttttaaaaaatgatcatttgggttcactcaggaaatgcatgtcaggaaacttgtattataagtttattagttgtgatgtatcagtaactgctgttacccctttttcaaagaaatgtaattgattttgaagttttctagattgtcacatgctttgtgactaatgcaagaaagcaagtcctgtgttgtatttgttctagtcatttttattcaggctatatattgtagcttaatttttatttgcaattaatttatttaaactaagtaaatacttttcaaaata

SEQ ID NO: 5591 - DNA, 4146 bp, Homo sapiens
gaccactgagacgagcgggagcgcggagcagcagcctctgctgccctgactttttaagaaatctcaatgaactatttgtagagaatcactgatccggcctgcaagcattttgcacggcaaaaatatcgatcagtgttaagtgaagatcacattttatatgcgatcttgacttttttgtcttacattatatttttatagattttgttataaacatggtgctgggaaaggtgaagagtttgacaataagctttgactgtcttaatgacagcaatgtccctgtgtattctagtggggataccgtctcaggaagggtaaatttagaagttactggggaaatcagagtaaaatctcttaaaattcatgcaagaggacatgcgaaagtacgctggactgaatctagaaacgccggctccaatactgcctatacacagaattacactgaagaagtagagtatttcaaccataaagacatcttaattgggcacgaaagagatgatgataattccgaagaaggcttccacactattcattcaggaaggcatgaatatgcattcagcttcgagcttccacagacaccactcgctacctcattcgaaggccgacatggcagtgtgcgctattgggtgaaagccgaattgcacaggccttggctactaccagtaaaattaaagaaggaatttacagtctttgagcatatagatatcaacactccttcattactgtcaccccaagcaggcacaaaagaaaagacactctgttgctggttctgtacctcaggcccaatatccttaagtgccaaaattgaaaggaagggctataccccaggtgaatcaattcagatatttgctgagattgagaactgctcttcccgaatggtggtgccaaaggcagccatttaccaaacacaggccttctatgccaaagggaaaatgaaggaagtaaaacagcttgtggctaacttgcgtggggaatccttatcatctggaaagacagagacgtggaatggcaagttgctgaaaattccaccagtttctccctctatcctcgactgtagtataatccgcgtggaatattcactaatggtatatgtggatattcctggagctatggatttatttcttaatttgccacttgtcatcggtaccattcctctacatccatttggtagcagaacctcaagtgtaagcagtcagtgtagcatgaatatgaactggctcagtttatcacttcctgaaagacctgaagcaccacccagctatgcagaagtggtaacagaggaacaaaggcggaacaatcttgcaccagtgagtgcttgtgatgactttgagagagcccttcaaggaccactgtttgcatatatccaggagtttcgattcttgcctccacctctttattcagagattgatccaaatcctgatcagtcagcagatgatagaccatcctgcccctctcgttgaaggaacacttggttgaatcaagttgatgtgggttccgaactgtatctcttccggctgaggacagagaagtatcttggagacacgtttcagaggaagtggaattacttttgcccagaaaaatggcgaatacatgaaacaaccagtgatcatgctttagaagcctacagcaacattctgagactgctccaacatgcttgaagatctaagcttttctcttttaaaactggcacatactcagagcagtcttcttagcctatggtcgtacgtgtcaagacatcacgttgtaaagagggatgatttccttcttttgatttgaaaatttgcacatgctcaatgcttacattgtgcggttcgacgtcactacagcttctttttttttttttttttctatttttgccagactcttgatactcttaaaacttgtttgtggtcagcacaacaaggaacaaaacaaagctttgaaaaaactttaacatgaaaaaacgcactgacatttttttttatttaatatagcctggactttacctgcgtatgcacatgctcagaattgtctactaggctgactatgtatcacctcttcagcttggatccaattgtggatttatttacaaacatcaaatgccttcaagccaatcctttttgctgtatgttttgcagcctactgtagtagatacgcaacagataatgtgggaaaaaaagagataagaggaggaagctaataagagactgtcaagattgtataccttcttggtttcttttaagaatttgttgcctttctactattacagcaaagcagcattttgttactgactgcctaaaatcacttaatctcaggtgaacgcatcacttgccaaactgttggaatgctatttgtgttttgttgcactgtttttttcgtttgtttgtttgtttatttggttggctttttggagagggaaatttggaaacgggacatacacaaaagttacacacccacattccctttttatcatgacatacaagaagaaactagcagagctaagaatggagtgaagaaaggcagtatggcaggcaccagcaaagagttgagggctgttgctcttaaaaattattttttttattattattttgaaagtatggaagttttccattcactggggaaaggagggaaaagtgcatttatttttatacagagttacttaattacctccaaaacacatatgttggaaatcgcttttgctggtgcaaagtatattaatgagcaggaatacatacattgaggttatgaatagagagctcaatttgtacctttgctgtcttgctcaagcttggtatggcatgaaaactcgactttattccaaaagtaacttcaaaatttaaaatactagaacgtttgctgcgataaatcttttggatttttgtgtttttctaatgagaatactgtttttcattacctaaagaacaatttgctaaacatgagaaatcactcactttgattatgtatagattacataggaagaacaatcacatcagtaagttatagtttatattaaaggtaattttctgttggctcataacaaatataccagcattcatgatagcatttcagcattttccaaggtaccaagtgtacttattttgttgttgttgttgttgttgtattttagaaggaattcagctctgatgtttttaaagaaaaccagcatctctgatgttgcaacatacgtgtaaaatgggtgttacatctatcctgccatttaaccccacagttaataaagtggctgaaaataatagtagctctggcttggtgcttgacctggttaaatactgtcttaaagctcatacaaaacaaataggcttttccataagtggcctttaagaaaacatggaagacaattcatgtttgacaaatgctgacagggtgaagaaagcccagtgtaaaaatgaatcgcgttttaagtgattcggttaaagagtttgggctcccgtagcaaactaatactagataataaggaaatgggggtgaaatatttttttattgttgaatcattttgtgaatgtccccctcaaaaaaagctaatggaatatttggcataaagggcatttggtggttttatttttgtttgagggggattgtcagaaaatcccttttctctcttacgtctaactgactagggaacaattgttgatatgcatagcattggaatacttgtcattatatactcttacaaataacacatgaagcaagaatgaccaatattctgataattggcactggatcacaaaatgtgataaaactttaaatgtataaaactttatcaaataaagttttattttcccctttaaaatgtatttctttagaggcattacttttttaaaaatattggtcaattcctgacataagatgtgaggttcacagttgtattccagtattcaagatagattcctgatttttcaattaggaaaagtaaaatccaaaatgttagcaaaacaaagtgcaatattaaatgtttgctttatagattatattctatggctgtttgtaatttctctttttttccttttttatttggtgctgaatatgtccttgtaggctctgttttaagaaaacaatatgtgggaaatgatttaatttttcctattgctcttccttgtggaaaataaagtgttttgtttttttctgttttgtataaaaaaaaaaaaaaaaaaa

SEQ ID NO: 5592 - DNA, 5274 bp, Homo sapiens
cggccgcccctctggctgctctgcctggtcgcgtgctggctcctgggcgccggggccgaagccgacttctccatcctggacgaggcgcaagtgctggcgagccagatgcggaggctggcggccgaggagctgggggtcgtcaccatgcagcggatattcaactcctttgtttacactgagaaaatctcaaatggagaaagtgaagtacagcagctagccaaaaaaatccgagagaagttcaaccgttacttggatgtggtcaatcggaacaagcaagttgtagaagcatcctatacggctcacctaacctctcccctaactgcaattcaagactgctgtactatcccaccttccatgatggaattcgatgggaactttaataccaatgtgtctagaacaattagttgtgatcgactttctactactgttaatagccgggccttcaatccaggacgagacttaaattcagttcttgcagacaacctgaaatccaaccctggaattaagtggcaatatttcagttcagaagaaggaattttcactgttttcccagcacacaagttccggtgtaagggcagctacgaacaccgcagtagacccatctacgtctctacagtccggccgcagtcaaagcacatagtagtgattctggaccacggggcttcagtcacagacactcagcttcagattgccaaggacgctgctcaggtcatcctcagcgccatcgatgaacatgacaagatttctgtgttaactgtggcagataccgtccggacttgctcactagaccagtgctataagaccttcttgtctccagccaccagtgagacaaaaaggaaaatgtccacctttgttagcagcgtgaagtcttcagacagtcctacccagcacgcagtgggattccaaaaggcatttcagctgattcgaagtacaaacaataacacaaagttccaagcaaatacagacatggtcatcatttacctgtcagctggcattacatcaaaggactcttcggaagaagataaaaaagcgactctccaagtcatcaatgaagaaaatagctttctaaacaactctgtaatgattctcacctatgccctcatgaacgatggggtgactggtttgaaagagctggcttttctgagggatctagctgaacagaattcagggaagtacggtgtgccagaccggatggccttgcctgtgattaagggcagcatgatggtgctgaatcagttgagcaacctggagaccacagtgggcaggttctacacaaaccttcccaaccggatgattgatgaagccgtcttcagcctgcccttctctgatgagatgggagatggtttgataatgactgtgagtaaaccctgttattttggaaacctacttctgggaattgtaggtgtggacgtgaatctggcttacattcttgaagacgtgacgtattaccaagactctttggcttcctatacttttctcatagacgacaaaggatatacacttatgcacccatctcttaccaggccatatttattgtcagagcccccacttcatactgacatcatacattatgaaaatattccaaaatttgaattagttcggcaaaatatcctaagcctccctctgggcagccagattatcgcagtccctgtgaactcatccctgtcttggcacataaacaagctgagagaaactggaaaggaagcctacaatgttagctatgcctggaagatggtacaagacacttcctttattctgtgtattgtggtgatacaaccagaaatacctgtgaaacaactgaagaacctcaacactgttcccagcagcaagctgctgtaccaccggctggatctccttggccagcccagtgcttgcctccacttcaaacagctggcaaccctagaaagtcccaccatcatgctgtctgctggcagcttttcctccccctatgagcacctcagccagccagagacaaagcgcatggtagagcactacaccgcctatctcagcgacaacacccgcctcattgctaacccgggcctcaaattctctgtcagaaatgaagtaatggctaccagccacgtcacagatgaatggatgacacaaatggaaatgagtagcctgaacacttacattgtccgccgttacatagcaacacccaatggcgtcctcagaatttatcctggttccctcatggacaaagcatttgatcccactaggagacaatggtatctccatgcagtagctaatccagggttgatttctttgactggtccttacttagatgttggaggagctggttatgttgtgacaatcagtcacacaattcattcatccagtacacagctgtcttctgggcacactgtggctgtgatgggcattgacttcacactcagatacttctacaaagttctgatggacctattacctgtctgtaaccaagatggtggcaacaaaataaggtgcttcataatggaggacaggggttatctggtggcgcacccgactctcatcgaccccaaaggacatgcacctgtggagcagcagcacatcacccacaaggagcccctggtagcaaatgatatcctcaaccaccccaactttgtaaagaaaaacctgtgcaacagcttcagtgacagaacggtccagaggttttataaattcaacaccagccttgcgggggatttgacgaaccttgtgcatggcagccactgttccaaatacagattagcaaggatcccaggaaccaacgcgtttgttggcattgtcaacgaaacctgcgactctcttgccttctgtgcctgcagcatggtggaccgactctgtctcaactgtcaccgaatggaacaaaatgaatgtgaatgtccttgtgagtgccctctagaggtcaatgagtgcactggcaacctcaccaatgcagagaaccgaaaccccagctgcgaggtccaccaggagccggtgacatacacagctattgaccctggcctgcaagatgctcttcaccagtgtgtcaacagcaggtgcagtcagaggctggaaagtggggactgttttggggtgctggattgtgaatggtgcatggtggacagtgatggaaagactcacctggacaaaccctactgtgccccccagaaagaatgcttcggggggattgtgggagccaaaagtccctacgttgatgacatgggagcaataggtgatgaggtgatcacattaaacatgattaaaagcgcccctgtgggtcctgtggctggagggatcatgggatgcatcatggtcttggtcctggcggtgtatgcctaccgccaccagattcatcgccggagccatcagcatatgtctcctcttgctgcccaagaaatgtcagtgcgtatgtccaacctggagaatgacagagatgaaagggacgacgacagccacgaagacagaggcatcatcagcaacactcggtttatagctgcggtcatcgaacgacatgcacacagtccagaaagaaggcgccgctactggggtcgatcaggaacagaaagtgatcatggttacagcaccatgagcccacaggaggacagtgaaaatcctccatgcaacaatgaccccttgtcagccggggtcgatgtgggaaaccatgatgaggacttagacctggataccccccctcagactgctgccctactaagtcacaagttccaccactaccggtcacaccaccctacacttcatcatagccaccacttacaggcggccgtcacggtacacactgtcgatgcagaatgctaacaatctcctcacctccacgccaagatgagatctgggagctacagaatgttctggaaagaaaaagaaccggcttaaaacccacagcaagagacctcccttgtgtttgtgctttgtgcagagttgtttgagtcatttcctgcctgtcgacatggttaaaaacgagagaaacaacaacacagtcacatttgtgaagatgtgaggctggttctgaaatggaggggaaataagcctgatgaacagacctgccataacactaatggaaggtaacagaaggcgaacctccaaacacagagacggaacctgcaagtgaagctgagccagaggaatgttccaaagagccagaagcattcagctctccttaactggaagagagaaaaatctgctcacccagagactggaatgtggcacatgcagatacaaatgtgtgcattgaagatttcgctttgtttcttagcggtacctggataccacagttgctgtatggaactcatgttatgctctaaacgatgcatctcagaatttctaagtaaaggattatttttctactatttattgaactttcaaacattctcaaactttggggaaaaggaaaggaaacacaggagaagttttcagcagttgccccgagctgttttgtgtgtaatgaagtggttctttgattaaggagctctatttcttatttaactgatatcccactgccccactccacaaaataggaaaatgaagaaatctttctctctgacttgtttacatcatttcacggaaacacatctttgtttgtaatgcagtattctttctctgtgtttgacagagatggggaggggcagaggaatttaagaggttttaaaagaaatgttatgtttcttatgacttgtttccactcctcgtacaatgctattcttaggtttctacgaaacctaatgttagaaccgcatcctttcagctaagggagggttggatttattttccttgttttagagactacaaatttttaaatatcccattttgactgagaatattgacatataagggaagaagttttctaaattgtgaaagtctggttcttaattaaagaattttttttttaatatcacggttaaaagctgctgccagttagccaagacattatccaccaaattgctttgtgatttatacagggattaatcaaatctggctactataacatggggcattgtaactttaaagtagtgttttaattacagtgatgtattttagactcacattttgtgattcaaatatgttataaaggcattcttgcaccatggtaaagaatgtgtgtggtaaatctccgtttatatgtagttggaaaaaattcactgaataatgttttaatgatagggtattatgatacaatgtaaaaaacaattggttcttcagcagtacagaaagtaaactatatatgtgctatcaggaaaccccttcatactgtgtataaaattgcaatctagtgaaataaaccgtatgcaatggaccatt

SEQ ID NO: 5593 - DNA, 3695 bp, Homo sapiens
gccccgtcccggcctcgcgcacctgctcaggccatgatgagcttcggcggcgcggacgcgctgctgggcgccccgttcgcgccgctgcatggcggcggcagcctccactacgcgctagcccgaaagggtggcgcaggcgggacgcgctccgccgctggctcctccagcggcttccactcgtggacacggacgtccgtgagctccgtgtccgcctcgcccagccgcttccgtggcgcaggcgccgcctcaagcaccgactcgctggacacgctgagcaacgggccggagggctgcatggtggcggtggccacctcacgcagtgagaaggagcagctgcaggcgctgaacgaccgcttcgccgggtacatcgacaaggtgcggcagctggaggcgcacaaccgcagcctggagggcgaggctgcggcgctgcggcagcagcaggcgggccgctccgctatgggcgagctgtacgagcgcgaggtccgcgagatgcgcggcgcggtgctgcgcctgggcgcggcgcgcggtcagctacgcctggagcaggagcacctgctcgaggacatcgcgcacgtgcgccagcgcctagacgacgaggcccggcagcgagaggaggccgaggcggcggcccgcgcgctggcgcgcttcgcgcaggaggccgaggcggcgcgcgtggacctgcagaagaaggcgcaggcgctgcaggaggagtgcggctacctgcggcgccaccaccaggaagaggtgggcgagctgctcggccagatccagggctccggcgccgcgcaggcgcagatgcaggccgagacgcgcgacgccctgaagtgcgacgtgacgtcggcgctgcgcgagattcgcgcgcagcttgaaggccacgcggtgcagagcacgctgcagtccgaggagtggttccgagtgaggctggaccgactgtcggaggcagccaaggtgaacacagacgctatgcgctcagcgcaggaggagataactgagtaccggcgtcagctgcaggccaggaccacagagctggaggcactgaaaagcaccaaggactcactggagaggcagcgctctgagctggaggaccgtcatcaggccgacattgcctcctaccaggaagccattcagcagctggacgctgagctgaggaacaccaagtgggagatggccgcccagctgcgagaataccaggacctgctcaatgtcaagatggctctggatatagagatagccgcttacagaaaactcctggaaggtgaagagtgtcggattggctttggcccaattcctttctcgcttccagaaggactccccaaaattccctctgtgtccactcacataaaggtgaaaagcgaagagaagatcaaagtggtggagaagtctgagaaagaaactgtgattgtggaggaacagacagaggagacccaagtgactgaagaagtgactgaagaagaggagaaagaggccaaagaggaggagggcaaggaggaagaagggggtgaagaagaggaggcagaagggggagaagaagaaacaaagtctcccccagcagaagaggctgcatccccagagaaggaagccaagtcaccagtaaaggaagaggcaaagtcaccggctgaggccaagtccccagagaaggaggaagcaaaatccccagccgaagtcaagtcccctgagaaggccaagtctccagcaaaggaagaggcaaagtcaccgcctgaggccaagtccccagagaaggaggaagcaaaatctccagctgaggtcaagtcccccgagaaggccaagtccccagcaaaggaagaggcaaagtcaccggctgaggccaagtctccagagaaggccaagtccccagtgaaggaagaagcaaagtcaccggctgaggccaagtccccagtgaaggaagaagcaaaatctccagctgaggtcaagtccccggaaaaggccaagtctccaacgaaggaggaagcaaagtcccctgagaaggccaagtccccagagaaggaagaggccaagtcccctgagaaggccaagtccccagtgaaggcagaagcaaagtcccctgagaaggccaagtccccagtgaaggcagaagcaaagtcccctgagaaggccaagtccccagtgaaggaagaagcaaagtcccctgagaaggccaagtccccagtgaaggaagaagcaaagtcccctgagaaggccaagtccccagtgaaggaagaagcaaagacccccgagaaggccaagtccccagtgaaggaagaagccaagtccccagagaaggccaagtccccagagaaggccaagactcttgatgtgaagtctccagaagccaagactccagcgaaggaggaagcaaggtcccctgcagacaaattccctgaaaaggccaaaagccctgtcaaggaggaggtcaagtccccagagaaggcgaaatctcccctgaaggaggatgccaaggcccctgagaaggagatcccaaaaaaggaagaggtgaagtccccagtgaaggaggaggagaagccccaggaggtgaaagtcaaagagcccccaaagaaggcagaggaagagaaagcccctgccacaccaaaaacagaggagaagaaggacagcaagaaagaggaggcacccaagaaggaggctccaaagcccaaggtggaggagaagaaggaacctgctgtcgaaaagcccaaagaatccaaagttgaagccaagaaggaagaggctgaagataagaaaaaagtccccaccccagagaaggaggctcctgccaaggtggaggtgaaggaagacgctaaacccaaagaaaagacagaggtagccaagaaggaaccagatgatgccaaggccaaggaacccagcaaaccagcagagaagaaggaggcagcaccggagaaaaaagacaccaaggaggagaaggccaagaagcctgaggagaaacccaagacagaggccaaagccaaggaagatgacaagaccctctcaaaagagcctagcaagcctaaggcagaaaaggctgaaaaatcctccagcacagaccaaaaagacagcaagcctccagagaaggccacagaagacaaggccgccaaggggaagtaaggcagggagaaaggaacatccggaacagccaaagaaactcagaagagtcccggagctcaaggatcagagtaacacaattttcactttttctgtctttatgtaagaagaaactgcttagatgacggggcctccttcttcaaacaggaatttctgttagcaatatgttagcaagagagggcactcccaggcccctgcccccaggccctccccaggcgatggacaattatgatagcttatgtagctgaatgtgatacatgccgaatgccacacgtaaacacttgactataaaaactgcccccctcctttccaaataagtgcatttattgcctctatgtgcaactgacagatgaccgcaataatgaatgagcagttagaaatacattatgcttgagatgtcttaacctattcccaaatgccttctgttttccaaaggagtggtcaagcccttgcccagagctctctattctggaagagcggtccaggtggggccggggactggccactgaattatgccagggcgcactttccactggagttcactttcaattgcttctgtgcaataaaaccaagtgcttataaaatgaaaaaaaaaaaaaaaa

SEQ ID NO: 5594 - DNA, 6463 bp, Homo sapiens
atcctgggctcccagctggagaggcggaggcagctccagggggctggaagtggaagcgcagcggcagaaggagagggagagagaaagagagagaggctaattaaaaaaggatactccgagggaagagagcaagggcggtgcgccgccaaggaccaactagcggcggagcttcgatcttgcctaggcgcggagagctcccaacctgggctggaaccttgcccagcacaggtggctgctacaccccatgtaaaaagcggaaaataaaatgaagattttccagcgcaagatgcggtactggttgcttccaccttttttggcaattgtttatttctgcaccattgtccaaggtcaagtggctccacccacaaggttaagatataatgtaatatctcatgacagtatacagatttcatggaaggctccaagagggaaatttggtggttacaaacttcttgtgactccaacttcaggtggaaaaactaaccagctgaatctgcagaacactgcaactaaagcaattattcaaggccttatgccagaccagaattacacagttcaaattattgcatacaataaagataaagaaagcaagccagctcaaggccaattcagaattaaagatttagaaaaaagaaaggatccaaagcccagagtcaaagttgtggacagaggaaatgggagtagaccatcttcaccagaagaagtgaaatttgtctgtcaaactccagcaattgctgacattgtaatcctggtcgatggttcatggagtattggaagattcaacttcagactggttcggcatttcttggaaaacctggttacagcattcgatgtgggctcagagaagacacgaattggtcttgcacagtatagtggtgaccccagaatagaatggcacttgaatgcatttagcacaaaagatgaagtgattgaagctgtccgaaacctcccatataaaggaggaaatacactaacaggtcttgctttgaactacatttttgaaaatagcttcaaaccagaagcaggatcaaggactggagtatccaaaattggcattttaatcacagatggaaaatcccaagatgacattattccaccatctagaaatcttcgtgagtctggtgtagaactgtttgccataggggtgaaaaacgcggatgtgaatgagctgcaggagatcgcctctgaaccagacagcactcatgtgtacaatgttgccgaattcgatctgatgcacacagttgtggagagtctgaccaggactctctgctctagagtggaagaacaggacagagaaattaaagcctcagcccatgccatcactgggccgcctacggagttgattacttctgaagtcactgccagaagctttatggttaactggactcatgccccaggaaatgtggaaaaatacagagttgtgtattatcctaccaggggtggaaaaccagacgaggtggtggtagatggaactgtatcttccacagtgttgaaaaacttgatgtctttaactgaatatcagatagcagtctttgcaatctatgcccacactgctagtgaaggcctacggggaactgaaactacacttgctttaccgatggcttctgaccttctactgtacgacgtgactgagaacagcatgcgagtcaaatgggatgcagtgcctggggcctcaggttacctgatcctttatgctcctctaacagagggcctggctggggatgaaaaagagatgaaaattggagagacccacacagatattgaattgagtgggttgttgcccaatacagaatacacagtcacagtttatgccatgtttggagaagaggccagtgatcctgttacgggacaagaaacaacattggctttaagtccaccaagaaacctgagaatctccaatgttggctctaacagtgctcgattaacctgggacccaacttcaagacagatcaatggttatcgaattgtatataacaatgcagatgggactgaaatcaatgaggttgaagtcgatcctattactaccttccctctgaagggcttgacacctctcacagagtatactattgctattttctccatctatgatgaaggacagtcagagcctctgactggagtttttaccaccgaggaagttccagcccagcaatacttagaaattgatgaggtgacgacagacagttttagggtgacctggcatcccctctcagctgatgaagggctacacaaattgatgtggattccagtctatggggggaagactgaggaggttgtcctgaaagaagagcaggactcacatgttattgaaggcctggagcccggtacggagtatgaagtttcactattggccgtacttgatgatggaagcgagagtgaggtggtgactgctgtcgggaccacacttgacagtttttggacagaaccagctacaaccatagtgcctaccacatctgtgacttcagttttccagacgggaatcagaaacctagttgtaggtgatgaaactacttctagcctgcgggtaaaatgggacatttctgacagcgatgtgcagcagtttagggtgacctacatgacagctcaaggggaccctgaggaagaagtcataggaacggttatggtgcctggaagccagaacaacctccttctgaagcctctgcttcctgatactgaatacaaagtcacagtgactcccatctacacggatggcgaaggcgtcagcgtctccgctcctggaaaaaccttaccatcctcggggccccagaacttgcgggtgtccgaggaatggtataaccggttgcgcattacgtgggaccccccatcttccccggtgaaaggctatagaattgtctacaaacctgtcagtgttcctggtccaacactggaaacgtttgtgggagctgacattaacaccatccttatcacaaacctcctcagcggaatggactacaatgtgaagatatttgcctcccaggcctcaggcttcagcgacgccctgacaggcatggtgaaaacattgttcttgggtgttaccaatctccaagccaaacatgttgaaatgaccagcttgtgtgcccactggcaggtacatcgccatgccacagcctatagggttgttatagaatccctccaggataggcaaaagcaagaatccactgtgggtggagggacaaccaggcattgcttctatggacttcagcctgattctgaatataaaatcagtgtttatacaaagctccaggagattgaaggacctagtgtgagcataatggaaaaaacacaatcacttcctacacgaccaccaacttttcctccaaccattccaccagcaaaagaagtatgtaaggcggccaaggctgacctggtatttatggtggatggatcctggagcattggagatgaaaatttcaataagatcatcagctttctatacagcactgttggagccctgaacaagattggcacagatggaacccaagttgcaatggttcagttcactgatgatcccagaacagaatttaaactaaatgcttacaaaaccaaagagactcttcttgatgcaattaaacacatttcatacaaaggaggaaatacaaaaacaggaaaagcaattaagtatgttcgagataccttgttcactgcagagtcaggtacaagaaggggcatcccaaaggttatcgtggttataactgatggaagatcacaagatgatgtgaacaaaatctccagggagatgcaattagatggctatagcatttttgcaattggtgtggccgatgcagattactcggagttggttagcattggcagtaagcccagcgcacgccatgtcttctttgtggatgactttgacgcctttaagaaaatcgaagatgagttaattacttttgtctgcgaaacagcatcagcaacctgtccagtggtacacaaggatggcattgatcttgcaggatttaagatgatggaaatgtttggtttggttgaaaaagatttttcatcagtggaaggggtttctatggagcctggtaccttcaatgtgtttccatgttaccaactccataaagatgccctggtttcccagccaaccaggtacttgcacccagaaggattgccctccgactacacaatcagttttctattccggattcttcctgacactccacaggagccatttgctctttgggagattttaaataaaaattctgacccattggttggggttattttagacaatggtgggaaaactctaacatatttcaactatgaccagagtggggattttcaaactgttactttcgaaggacctgaaattaggaaaattttttatggaagctttcacaagctacacattgttgtcagtgagactttggtcaaagtggttattgactgcaagcaagtgggtgagaaggcaatgaacgcatcagctaatatcacgtcagatggtgtagaagtgctagggaaaatggttcgatcaagaggaccaggtggaaactctgcaccgttccagttacagatgtttgatattgtttgctccacatcatgggccaatacagacaaatgctgtgaacttccaggcctgagagatgatgagtcttgcccagaccttccccattcctgctcctgttctgaaaccaatgaagtggctctgggaccagcgggcccaccaggtggtccaggactccgaggaccaaagggccagcaaggtgaaccgggtccaaagggaccagatggccctcggggtgaaattggtctgccaggacctcagggtccacctggacctcaaggaccaagtggtctgtccattcaaggaatgcccggaatgccaggagaaaaaggagagaaaggagatactggccttccaggtccacagggtatcccaggaggcgttggttcaccaggacgtgatggctcaccaggccagaggggccttccgggaaaggatggatcctcgggacctccaggaccaccagggccaataggcattcctggcacccctggagtcccagggatcacaggaagcatgggaccgcaaggcgccctgggaccacctggtgtccctggagcaaagggggaacgaggagagcggggtgacctgcagtctcaagccatggtgagatcagtggcgcgtcaagtatgcgaacagctcatccagagtcacatggccaggtacactgccatcctcaaccagattcccagccactcctcatccatccggactgtccaagggcctcctggggagcctgggaggccaggctcacctggagcccctggtgaacaaggacccccaggcacaccaggcttccccggaaatgcaggcgtgccagggaccccaggagaacgaggtctaactggtatcaaaggagaaaaaggaaatccaggcgttggaacccaaggtccaagaggcccccctggaccagcaggaccttcaggggagagtcggcctggcagccctgggccccctggctctcctggaccaagaggcccaccaggtcatctgggggttcctggaccccaaggtccttctggccagcctggatattgtgacccctcatcatgttctgcctatggtgtgagagctccccatccagatcagccagagttcacccctgtccaagatgagctggaagccatggaactgtggggccctggagtctgatagcctcaggagaaatttgaagaccaactgcaagaactcttaaggaatcttgtttgagaaaatgttgttatgtggtttgtatgctacttttggggggcagggctcatttcagcagcctaaatctcctccttggataatgttaatattattattattattaacaaaaaatatatatttttaaaaagttcccttaatctatgacatggtagcaatgatttccctttggtgtcttaatggcatgtcagataatttgtttttccagagaagagagctcaaagaggaattgggaaaaataaattgaactctggaatcttctctctcaagtcctaaaatgaacaaacagatatgattgtgtttgagggaaatatgtccctagcaggaaaagaattcaaagaggttcaaagaatatgtcacttactcctacttgctgtaggaataaccttgctgataagaaaaaaagggacaatattggagaaactacctcttgtttaattgatctgtccaactctgagatcacttggtaactggtttcatgtgtatccaaaaatcagcatttggatttaagctttctgaatttggtagtttaagaaacagatttagtttttcaatggttttaactcatgtgaaataatgattttccaccagctctgatgcaaagagatataattttaatgaacgatttatccagcagtgtgttccaggggttgcctctccttatctacggggattactttgtacatgcagataagttttcgcaaacctatttccattttcttttgtaagcaaataaaactttaaaacaaaaaa

SEQ ID NO: 5595 - DNA, 8306 bp, Homo sapiens
ggagagggagggagggagagagagagagagggagagagacggatatctcaggtcatctgcagctgcagcgagtctgaggagccgaggaaggcagggaagatggcgatcctccattgctgagacccggcagaagcacatgagactcccaaacaacttccacaacaataacccgagcaggaagaggagaaagagaaagaggataaggaggcggtggggctggagaacccgaagcacctcccggcgccgggacgcttcttctgttcctaatgtgagaggctagacccagatcatggaggtgcttcagtgtgatggctgtgatttccgagccccgtcttatgaagatctcaaggcacacattcaggatgtccacacggcatttctgcagccaactgatgttgctgaggacaatgtgaatgagctacgatgtgggtccgtgaatgccagtaatcagacagaggtggagttttcttctataaaggatgaatttgccattgcagaagatttatcaggtcaaaatgcaacttcattggggaccggaggttactatggccacagtccaggatattatggtcagcatattgccgctaatcccaaaccaacaaacaagttttttcaatgcaagttctgtgtacgctacttcaggtcaaaaaacctcctcatagaacacactagaaaggtccatggagctcaagctgaagggagttcatcaggaccccctgtcccgggatccttaaattataatatcatgatgcacgagggatttggaaaggtcttctcttgccagttttgcacatacaagtcaccaagaagggcaagaataattaagcatcagaagatgtatcacaaaaacaatttgaaggagaccactgctcccccacctgctcctgctccaatgccagaccctgtggttccgcccgtatcactgcaggacccctgcaaggaactgccagcagaggttgtggagcgcagcatcttagagtctatggtcaagcctttgaccaaatctcgaggcaacttttgttgtgagtggtgcagctaccagaccccccgccgagaacgctggtgtgaccacatgatgaagaaacaccgcagtatggtcaagatcctttccagtctcagacagcaacaagaaggaactaatctacctgatgtgccgaacaagagtgcccccagccccacttccaactccacctatctgaccatgaatgctgcaagccgggagatacccaatactaccgtctccaacttcaggggctccatgggcaactccatcatgagacccaattcttcagcttccaagttttcgcccatgtcttaccctcagatgaagccgaagtcacctcacaattctggtctagttaacttgacagagagatcccgttatggaatgactgacatgaccaattcttctgctgacctggaaactaacagcatgctaaatgactctagttctgatgaagagttaaatgaaatagacagtgagaatggtttaagtgctatggatcaccagacatcaggcctgtctgcagagcagctgatgggctcagatggcaacaaattattggagaccaaggggattccatttagaagattcatgaataggttccagtgccccttttgtcctttcctcaccatgcatcgacgtagcatctctcgtcacatagaaaacatccacttatctggaaagacagctgtctacaaatgtgacgaatgtccgtttacttgcaagagctcgttgaaacttggggctcacaaacagtgtcacacgggtacaacgtcagattgggatgctgtgaattcccagagtgaaagcatttcttcctcactgaatgaaggtgtggtgtcttatgagagctcaagcatcaatggtagaaagtcaggagtcatgttggatcccttgcagcagcaacagccaccgcagccaccaccaccgccgccgccaccaccaccatcacagccacagccactgcagcagccacagccaccacagctgcagccaccacatcaggtgccaccccagccacaaacacagccaccaccaacgcagcagccacagccacccacacaagccgcacctctgcacccatacaaatgcaccatgtgtaattactccaccacaactctgaaagggctaagagtccatcagcagcataaacattcattctgtgacaacttgccaaaattcgaggggcagccctcaagcctaccattggaaaatgagacagacagccacccctcttccagcaacactgtgaagaaaagtcagacctcaattcttgggttgtcctccaagaacaattttgtagctaaagcctctaggaagctcgccaatgactttcctctagatttgtcacccgtgaagaagagaaccaggattgacgagatagcaagcaaccttcagagcaaaattaaccaaaccaaacagcaggaagatgcagtgatcaatgttgaggatgatgaagaggaagaggaagacaacgaagtcgagatagaggttgagttggacagggaggaagaaccgacagaacccatcatagaggttcccacttccttttctgcccaacagatatgggtaagagataccagtgagccccagaaagagcccaacttcagaaacatcacccacgattacaatgccaccaatggggctgagattgagctcaccctttctgaagatgaagaggattattatggctcctcaacaaacttgaaagatcaccaagtttccaatactgctctgctgaatacccaaactcccatctatgggactgagcacaatagtgaaaacacagactttggtgactctggaaggctttactattgtaaacactgtgactttaacaacaaatctgcccggagtgttagcacccactaccaacgaatgcacccatacattaaattcagctttaggtacatcttggaccccaatgatcacagtgcagtgtacaggtgcctggaatgctacatcgattacaccaacttcgaagatctccagcagcattatggcgagcaccacccagaagccatgaatgtactcaactttgatcactcggacctgatctaccggtgtcggttttgttcatacacgagcccgaatgttagaagcctgatgccacattaccaaagaatgcatcccacggtgaagatcaacaacgcgatgatattttcaagctatgtcgtggagcagcaggaagggctgaatacagaatcccagaccctgagggagattctgaattcggctcccaagaacatggcgacttccacacctgtggctcgtggtggtggtttgccagctacgttcaacaaaaacactcctaagacctttactcctgaatgtgaaaatcagaaggaccctttggtcaacactgttgttgtttatgattgtgatgtttgttcgtttgcaagccccaacatgcattctgtcttggttcattatcagaagaaacaccccgaagaaaaggcttcctactttaggatccagaaaactatgcgaatggtgtctgtggacaggggctctgccctttctcaattatcatttgaggtgggtgctccaatgtctcccaaaatgtccaacatgggttccccaccccccccacaacccccgccaccagacctcagtactgagctttactactgcaaacactgttcctacagcaatcggtcagttgtgggagtgcttgtccactaccagaaaagacacccagaaataaaggttactgccaaatatatcagacaggctcctcccacagctgcaatgatgagaggggtcgaagggccccaaggctccccccggccacccgcccccatacaacagctgaaccgaagcagctctgagagagatggccctcctgtggagaatgagatgttcttttgccagcactgtgattatgggaaccggacggtcaaaggggtactcattcattatcagaagaagcaccgagacttcaaggccaatgcagatgtgatccggcagcatacggccaccattcgaagcctctgcgaccgaaatcagaagaagcctgccagctgcgtgcttgtctccccctctaatctggagcgggacaaaacgaaactccgagcactcaaatgtaggcagtgctcatatacctccccctacttctatgcactgaggaagcatatcaagaaagaccaccccgccctgaaagccacagtcacgtccatcatgcgatgggcatttctagatggcttgatagaagctggctaccactgcgagtggtgcatctactcccatacggagcccaacggtttgctcctgcattaccaacggaggcatccagaacactatgttgattacacctacatggctactaaactgtgggctgggccagacccatcccctccctctctcacaatgccagccgaagccaaaacctacagatgcagggactgtgttttcgaagctgtttccatctgggacatcactaatcactaccaagcattccacccctgggccatgaatggtgatgagtcagtgctactggacatcatcaaggagaaagatgctgtggagaagcccattctttcatccgaagagttggcaggccctgtgaattgtgaaaacagtatacccacccctttcccggagcaggaagctgaatgtccagaggatgcaagactgtcccctgagaaaagcctgcagctagcttcagccaaccccgccatatcctccaccccataccagtgcacggtatgccaatctgagtataacaacttgcacggccttctcactcattatgggaagaagcaccctggcatgaaagtgaaggctgctgactttgcccaggacattgacatcaacccaggtgccgtctacaaatgcaggcattgcccatacatcaacacccgcatccacggcgtactgacccactaccagaagcgacacccgtccatcaaggtgaccgctgaggactttgtgcacgacgtagagcagtctgctgacatatcccagaatgacgtggaggagacgagcaggatcttcaagcaagggtatggcgcctaccggtgcaaactgtgtccgtacacacacggcactttggagaaactaaaaatccactacgagaagtatcacaatcagcctgaatttgatgtcttttcccagtcgcccccgaagctgccagtccccctcgagcccgagatgaccactgaagtgagcccttcccaagtctccatcactgaggaggaggtgggagaggagcccgtgtccacttctcacttctctacctcccacctggtctcccacactgtgttccggtgccagctctgcaagtacttctgctccacgaggaaggggatcgccaggcactaccgcatcaagcacaataatgtccgagcccagccagaaggcaagaacaacctcttcaagtgtgccctgtgtgcctacaccaaccccatccgcaaaggtctggcagcccactaccagaagcgccacgacattgatgcgtattacactcactgcttggcagcctccaggaccatcagcgacaagcccaacaaagtgatcatcccatccccgcccaaggacgactcccctcagctgagcgaggaactccggcgggcagtggagaagaaaaagtgctccttgtgctctttccagtcgttcagcaagaagggcatcgtgtcccattacatgaaacgccacccaggggtgttcccaaagaagcagcacgccagcaagttggggggctacttcacggccgtctatgcagatgagcatgagaagcccacactgatggaagaagaggagagaggcaactttgagaaagccgaggtggagggtgaagctcaggaaatcgagtggctcccattccgctgcatcaaatgcttcaagctgtcctttagcactgcagagctgctgtgcatgcattacactgaccaccacagtcgggacctaaagagggacttcatcattctgggcaacggcccccgcttgcagaactccacctaccagtgtaagcactgtgatagcaaactgcaaagcacagccgagctgacctcacacttgaacattcacaatgaggaattccagaagcgtgccaaacgtcaggagaggaggaaacagcttttgagcaagcagaaatatgcagatggtgcttttgcagatttcaaacaagagaggccttttggtcacttagaagaggtgccaaagatcaaggagaggaaagtggtgggctacaaatgtaaattctgtgtggaagtgcacccaacgctccgagccatctgcaatcacctccgaaagcacgtccagtatggcaatgtcccagctgtgtcagctgctgtgaaggggctgcgttctcatgagaggagccacctggccctggccatgtttacccgcgaggacaagtacagctgccagtattgctcgtttgtttctgctttcaggcacaatttggatcgccatatgcaaacccaccacggacaccataaaccattccgatgcaaactctgctccttcaagtcctcctataacagccggctgaaaacacatatactcaaagctcatgctggtgagcatgcctacaagtgttcttggtgctcattctccaccatgacaatcagccagctgaaggaacactccctcaaggtccacggaaaagccctgaccctccccaggccacggatcgtcagtctcctctcctcacactcccaccactcctcccaaaaagctaccccggctgaagaagtggaagactccaatgactcatcatattcagagcccccagatgttcagcagcagttgaaccactatcagtcagctgccctggcaaggaacaacagccgtgttagccctgtgcctctttctggggctgctgctggcactgagcagaaaactgaagccgtgcttcactgcgaattctgtgaattctcctccggctacatccagagcatcaggcgtcattaccgggacaagcatggtgggaagaagcttttcaagtgcaaagactgctccttttacacaggctttaaatctgcttttactatgcacgtggaagctgggcactcagcagttcccgaggagggccccaaagatcttcgctgtcctctctgcctctatcacaccaaatacaagcgcaacatgattgaccacatcgtgctgcaccgagaagagcgtgttgtccccattgaagtttgccggtccaaactgtccaaatacttgcagggagtagttttccgctgtgataagtgtaccttcacctgctccagtgatgagagcctccagcaacatatagaaaagcacaatgaactgaaaccttacaaatgccagctctgctactatgagaccaagcacacggaggaactggacagccaccttcgggatgagcataaggtaagccgtaactttgagctggttggacgggttaacttggatcagctggaacagatgaaggagaaaatggagagctccagcagcgatgatgaggacaaggaagaagaaatgaacagcaaggctgaagacagagagctgatgagattttctgaccacggggctgctcttaacactgagaagcgttttccatgtgaattttgtggacgggcgttttcacagggctctgagtgggaaagacatgtgctgagacacggcatggcattgaatgacaccaagcaggtgagcagagaagaaatccacccaaaagagatcatggagaacagtgttaaaatgccctccatagaggaaaaggaagatgacgaggccattgggatagacttttccctaaagaatgaaacagtagccatctgtgtagtaactgccgacaaatctctcctggagaatgcagaggccaaaaaagaatgagcgtttggtgaaattcttaatcaaaccttacttgaacagtgatgaaaaagtgggagggctggcttgggctgagaagggagggacagaaaagagaagacagaacaaagctgctttttaggactgaacaatctattttcaaagcactggtacctgtgtgagtgagtatgtaaattaaagttatttaaatggttggaatatgtggctccttttccatcactacatcttttcttccggatcttcatcatggaagtttcatttgttgcggaatatggaagcacctcccaatggtacggtgcaccctgtggtggtcttggacagtatgtggaaacagaagctccatgacggtagaagacttctcattggggagcaactttttgacgcacaacttttggtgcgtttttctagttttaataccttaagctttttcaagacctaactgcagccgctttgggaaaaaaaaacaaaaaacaaaaaacagaaaacaaaaaaaaaaaaa

SEQ ID NO: 5596 - DNA, 1952 bp, Homo sapiens
gtgatggggcgccgggtccagcctgttgctgatgctgccgtgcggtacttgtcatggagctggcactgcggcgctctcccgtcccgcggtggttgctgctgctgccgctgctgctgggcctgaacgcaggagctgtcattgactggcccacagaggagggcaaggaagtatgggattatgtgacggtccgcaaggatgcctacatgttctggtggctctattatgccaccaactcctgcaagaacttctcagaactgcccctggtcatgtggcttcagggcggtccaggcggttctagcactggatttggaaactttgaggaaattgggccccttgacagtgatctcaaaccacggaaaaccacctggctccaggctgccagtctcctatttgtggataatcccgtgggcactgggttcagttatgtgaatggtagtggtgcctatgccaaggacctggctatggtggcttcagacatgatggttctcctgaagaccttcttcagttgccacaaagaattccagacagttccattctacattttctcagagtcctatggaggaaaaatggcagctggcattggtctagagctttataaggccattcagcgagggaccatcaagtgcaactttgcgggggttgccttgggtgattcctggatctcccctgttgattcggtgctctcctggggaccttacctgtacagcatgtctcttctcgaagacaaaggtctggcagaggtgtctaaggttgcagagcaagtactgaatgccgtaaataaggggctctacagagaggccacagagctgtgggggaaagcagaaatgatcattgaacagaacacagatggggtgaacttctataacatcttaactaaaagcactcccacgtctacaatggagtcgagtctagaattcacacagagccacctagtttgtctttgtcagcgccacgtgagacacctacaacgagatgccttaagccagctcatgaatggccccatcagaaagaagctcaaaattattcctgaggatcaatcctggggaggccaggctaccaacgtctttgtgaacatggaggaggacttcatgaagccagtcattagcattgtggacgagttgctggaggcagggatcaacgtgacggtgtataatggacagctggatctcatcgtagataccatgggtcaggaggcctgggtgcggaaactgaagtggccagaactgcctaaattcagtcagctgaagtggaaggccctgtacagtgaccctaaatctttggaaacatctgcttttgtcaagtcctacaagaaccttgctttctactggattctgaaagctggtcatatggttccttctgaccaaggggacatggctctgaagatgatgagactggtgactcagcaagaataggatggatggggctggagatgagctggtttggccttggggcacagagctgagctgaggccgctgaagctgtaggaagcgccattcttccctgtatctaactggggctgtgatcaagaaggttctgaccagcttctgcagaggataaaatcattgtctctggaggcaatttggaaattatttctgcttcttaaaaaaacctaagattttttaaaaaattgatttgttttgatcaaaataaaggatgataatagatattattttttcttatgacagaagcaaatgatgtgatttatagaaaaactgggaaatacaggtacccaaagagtaaatcaacatctgtatacccccttcccaggggtaagcactgttaccaatttagcatatgtccttgcagaatttttttttctatatatacatatatattttttaccaaaatgaatcattactctatgttgttttactatttgtttgacatatcagtatatctgaaacaccttttcatgtcaataaatgttcttctctaacatttttaaaaaaaaa

SEQ ID NO: 5597 - DNA, 4682 bp, Homo sapiens
cttacggcagtctcgcgggatttccccctctcgcgggaattatttgaacgttcgagcggtaaatactccctggggctgtcatagaagactactcggagagcgctgcctctgggttggcgggctggcaggctgtagccgagcgcgggcaggactcgtcccggcagggttccagagccatgggagcggaaaggaggctgctgtcgattaaggaggcctttcggctggcgcagcagccgcaccagaaccaggcgaagctggtggtggcgctgagccgcacctaccgcacgatggatgataagacagtttttcatgaggagttcattcattaccttaaatatgttatggtggtctataaacgtgaaccagctgtggagagggtaatagaatttgcagcaaagtttgttacctcatttcaccaatcagatatggaagatgatgaggaagaggaagatggtggccttttaaattatttgtttacttttctcttaaagtctcatgaagcaaacagcaatgcagtgagatttagagtgtgcctgctcataaacaagcttttgggaagtatgccagaaaatgctcagattgatgatgatgtgtttgataaaattaataaagccatgcttattagattgaaagataagattccaaatgtgagaatacaggcagttctggcgctttcacgacttcaggatcccaaggatgatgaatgcccagtggttaatgcatatgctactttgattgaaaatgattcaaatccagaagttagacgggcagtgttatcatgtattgcaccatcagcaaagactttgccaaaaattgtagggcgcaccaaggatgtgaaagaggctgtcagaaagctggcttatcaggttttagctgaaaaggttcatatgagagctatgtccattgctcagagagtaatgctccttcaacaaggtcttaatgacagatcagatgctgtgaaacaagctatgcagaagcatcttcttcaaggctggttacggttctctgaaggaaatatcttagagttgctccatcggttggatgtagaaaattcttctgaagtggcagtctctgttctcaatgccttgttttcaataactcctctcagtgaactggtgggactctgtaaaaacaatgatggcaggaaattgattccagtggaaacattaactcctgaaattgctttgtattggtgtgccctttgtgaatatttgaaatcaaaaggagatgaaggtgaagaatttttagagcagattttgccagagcctgtagtatatgcagactatttattgagttacatccagagcattccagttgttaatgaagaacacagaggtgatttttcctatattggaaatttgatgacaaaagaattcataggtcaacaattgattctaattattaagtctttggataccagtgaagaaggaggaagaaaaaaactgctggctgttttacaggagattcttattttacccacaatcccaatatccctggtttcttttcttgttgaaagactactccacatcattatagatgataataagagaacacaaattgttacagaaattatctcagagattcgggcgcccattgttactgttggtgttaataacgatccagctgatgtaagaaagaaagaactcaagatggctgaaataaaagttaagcttatcgaagccaaagaagctttggaaaattgcattaccttacaggattttaatcgggcatcagaattaaaagaagaaataaaagcattagaagatgccagaataaaccttttgaaagagacagagcaacttgaaattaaagaagtccacatagagaagaatgatgctgaaacattgcagaaatgtcttattttatgctatgaactgttgaagcagatgtccatttcaacaggcttaagtgcaaccatgaatggaatcatcgaatctttgattcttcctggaataataagtattcatcctgttgtaagaaacctggctgttttatgcttgggatgctgtggactacagaatcaggattttgcaaggaaacacttcgtattactattgcaggttttgcaaattgatgatgtcacaataaaaataagtgctttaaaggcaatctttgaccaactgatgacgttcgggattgaaccatttaaaactaaaaaaatcaaaacacttcattgtgaaggtacagaaataaacagtgatgatgagcaagaatcaaaagaagttgaagagactgctacagctaagaatgttctgaaactcctttctgatttcttagatagtgaggtatctgaacttaggactggagctgcagaaggactagccaagctgatgttctctgggcttttggtcagcagcaggattctttctcgtcttattttgttatggtacaatcctgtgactgaagaggatgttcaacttcgacattgcctaggcgtgttcttccccgtgtttgcttatgcaagcaggactaatcaggaatgctttgaagaagcttttcttccaaccctgcaaacactggccaatgcccctgcatcttctcctttagctgaaattgatatcacaaatgttgctgagttacttgtagatttgacaagaccaagtggattaaatcctcaggccaagacttcccaagattatcaggccttaacagtacatgacaatttggctatgaaaatttgcaatgagatcttaacaagtccgtgctcgccagaaattcgagtctatacaaaagccttgagttctttagaactcagtagccatcttgcaaaagatcttctggttctattgaatgagattctggagcaagtaaaagataggacatgtctgagagctttggagaaaatcaagattcagttagaaaaaggaaataaagaatttggtgaccaagctgaagcagcacaggatgccaccttgactacaactactttccaaaatgaagatgaaaagaataaagaagtatatatgactccactcaggggtgtaaaagcaacccaagcatcaaagtctactcagctaaagactaacagaggacagagaaaagtgacagtttcagctaggacgaacaggaggtgtcagactgctgaagccgactctgaaagtgatcatgaagttccagaaccagaatcagaaatgaagatgagactaccaagacgagccaaaaccgcagcactagaaaaaagtaaacttaaccttgcccaatttctcaatgaagatctaagttaggaaagacgatggaggtggaatcctttaagattatgtccagttatttgctttaataaagaagaagttacccttgtcaaaatcagaacaaacctgatgtctttctgaagattttctgctgtgcgcttccacgttactttggcctgtattaaagcagtagagcagcatcagttattatagtccagaaaaagtgtgcatcagtcagtcacacagatttatcacaatctgaggtgggcctaggaatctcatttttaaatagtctctccaagtgattcttatgaactctttatgtttaaaatcatgtcattatggaaaacttacaagtgtaactagctagtagcttgcatttgagaagcttatgacttagatgggcagaatcaacaaagatgaaaccgcctgaggacacatttaacaagtaacatttctagggaaaatgaaggaagtaccacaaactggctagaaaggagcttatcaatcaccagtgaggaagaccagtataacgttcaacaacagttattttgacaaaaacttattttgtgattcctacagtgaaaacatttttggtgatatctgcctgggaaatctctcttcctaaagtatttgtatatgggagtccttgtttgtgaatgtttcctggattagggaggtgtcaacataaatgtattattaaccatgaagctgctcgctatatttttggcataacaaaataatatttatttactgtggataataattctagtgggaatataatgtgacaggaacttctctttatatacgctaccaatttatgagcactattcactgtcaatttcatttcttgtcttttgaaattgacacttggcctgacttacgaaacttgtactatatgaaattggtcctcttttctgcaatacccaacgaaacaccttttctctttattattcagaaatgtcctaacatggatctgtttgttttaataattgtgctttttttaggcttatcatctactagaggccatttacttaaggtgaaattttaagatggagctaaagtaagatcactggtttttagaaccaaattgctatacatatgtgcctcatagaacttataaaaggagtcaaagtttcaaagcaagatagttattaagcaaaaggaaaaatggtaatgatagaaagtcagttaaaaatagatgattgttcttcattctgtttgttggctctgtgttctcctgtgcttcagattccttatgtgttgttgttttaaagacaatttgcagggggttgggagaaggactgaaaaggtacattaagtgtgctgtaaggaaaagtcttagaaacataataagctaaaatcccattcacacatggccaggctatccaaaaagaaaggagccatgttctcatgtggtttaccataccaaagcttgctttctctggcatgggaaaaataaatttaagcaccaaaaaaaaaaaaaaaagaaaa

SEQ ID NO: 5598 - DNA, 5224 bp, Homo sapiens
aggctatctccagccgtggccgatggccgtgccgggggcagagcccgctcccctccgcgcgttgctacgtgcggggatgacatggatccagacgccgtcaactacgggaaggaggaggcgagagttggagcgcgtgggagcgcagaggccggaggagggaaacaccctcccggatccagagcccggcggcggcgaagcagcagctgcggccgcgcccttgccagagccggtgcgtccgcctagccccgctccgcctgaggccgtcagggctcccgaggatggaagattcccaggagacatcgccgtcctccaacaactcctcggaggagctcagctctgctctgcacctgtccaagggcatgtcgatcttcctcgacatactgaggagagcagacaaaaatgatgatggaaaattatcctttgaagaattcaaagcatattttgcagatggtgttctcagtggagaagaattacacgagcttttccataccattgatacacataatactaataatcttgacacagaagagctatgtgaatatttttctcagcacttgggcgagtatgagaatgtactagcagcacttgaagacctgaatctttccatcctgaaggcaatgggcaaaacaaagaaagactaccaagaagcctccaatttggaacaattcgtaactagatttttattgaaggaaaccctgaatcagctgcagtctctccagaattccctggaatgtgccatggaaactactgaggagcaaacccgtcaagaaaggcaagggccagccaagccagaagtcctgtcgattcaatggcctggaaaacgatcaagccgccgagtccagagacacaacagcttctccccaaacagccctcagtttaatgtcagcggtccaggcttattagaagaagacaaccagtggatgacccagataaatagactccagaaattaattgatagactggaaaagaaggatctcaaactcgaaccaccagaagaagaaattattgaagggaatactaaatctcacatcatgcttgtgcagcggcagatgtctgtgatagaagaggacctggaagaattccagctcgctctgaaacactacgtggagagtgcttcctcccaaagtggatgcttgcgtatttctatacagaagctttcaaatgaatctcgctacatgatctatgagttctgggagaatagtagtgtatggaatagccaccttcagacaaattatagcaagacattccaaagaagtaatgtggatttcttggaaactccagaactcacatctacaatgctagttcctgcttcgtggtggatcctgaacaactagatgttcctagacattttctttatggttccaagtgcaaaacaggtgttcttatctaaaacgtcaattagaaaattatctgcggttgttaatctactgtatatttttgtttggtatatttactaagtgcactctttcaaaacttattctataactttatcaattcatgtgaattttagctcaattttcaaagttcactaatattctcaatatttaatgctaaatgctttgctacattgtaactcacctaaaaccttttagtgacaaaatcctaatatgtggaaaaaagcatatgcataaaggaataatattgtgaaaatgaatctgttatgataaagaaaaaataaagtggaaacttttagagtattacttcatagggcagattttgtaaactgtcgtatactgtaaagggttaaatcagcgttttgtgatttttaagtaactgtgagtgaagtttattcttcaacaatgtctactccatccccaacccaactcacagccctatgactactatctttgcattagttaaaaagttagtatataggcatcaaacaaccttggctgtaacctatagaatctctatccacgtatcaggttatagactggtttttcaaaagtgaacaatcctgtgataagttggagtaccatttagtaatacagcaacattgtgtcatttattagcatcataattctttgttatgtaagttaaatatatcaagaaagaagagactgtttggaaaaatgtggttcaagttttatgctatatagttttggtatgcgatacagacagctaacttttcttatgaaaaatacatatttgcatgtaaacaatgatttcaaaatacttgaaaaataaaattttaacccaaatgaataactaagaaatataaaacaagcacaaaatcttagggaagtcataaaatagtagtgaaagtattagacagaagacatctgttttcgaatttcaacactagaatgactaaaactatctacctatagaactatctgtagatagtatactatctacactctgctcaacaagctcagaaattaaatatttttaataataaaaatctgttctggttataaaccttgctaatgaaaatacaatacatataaaaatgtatagccatgttattttctagtataaattcctttgaaactataagtctttgaggaaaattataaggtaaaattttcctgtttttccccctttgaaaaactcaggaaaaaaggaagattgaactaataaaattttatttcttaaatataaatttgacctaaaatattttctcaaactaattcatgaaacagcaacttttaccaatacctttgtatactctcagttctcattcagtataaataaaattttaaaatcctttcatagttctattagaaataagtagtaaattttgatatattgtacatacacacgtgtgtgtgtgtgtgtgtgtgtgtgtgtgtgtgtgtgtgtgtatttgtgtgcctctggtcaactctaaggatgacagacactgtgtaacaacacctgggtcaactcttttaatttatatacaaagcaaagaacaacattaatggagatgcacaatgattattcaaacaagctatatatatgtacaaaggcaaacagacacataacagtctctgcagactgattgtatatagtaagaaaagatcaaaagactttaaaacctaaatgacttttgacatacaaactcttcttgagaatgtttgttgtaaatggtttcaaaaatacaaattatagccaatcaaaacattgctttggttggtgcatttaagtatccaactcaaaaagcatatcaaatattttgggtactaggcagtttccaaagtagcatggtagtattacttgttaaaagggttctgttttcattaacagtactaagtggaagggatctgcagattccaaactggaataagctctatcatattctgaaacaagaattagaatgacttgagaacgggcaaataacaaagcaaaccaatataattatatggtcattctgaccccagctcttatacaaattatacatgtatttttgtgtatgtttgtgagagttgtatgtatgtgaatgtgtgtgagtgtgtattcacatacacatatatactggaacctatagtagaaaaggaaactagtagggccaaaaaaaaaaagaaaaagaaaaagaaaaaagaaaaaaaaagaaaaaactgggacctaagtataaatatctcatcctaaagtaaacaataagtttatagttaacgaagatttttttctatttaaaaccccattttcctaaagaacaaagtagtaaaataaaaaaaaatttaaaaaattaaaaaataaaaaaaagaggtcactaaaagaccaagatgggaaacgtaacatggaatacaagcttgaatctgggaaacaagctcaaaaaacagtgaaaaaaaaagtactggtttaggagttcaaaattcagtgaaacaaactttttgccaatagacctagggatctaagaaatagaattagggagagtttacacttacttacctatatatcagcagatttttctggaagaaaccctttttttttttttttttaaacagtaacatccagagtgacaaattgcaggagatttaatgtataaaatttctaggaattaaaagcttaaacccaaaaattgttcatccatatataagaaattatcgaattaaaacttaatgtatgtcaattattttcaaatgtctaaattcctttggaaataaaaatatcagttttactttgaaattgctcaacttctgctattcatatggtctgattagtgacataagtagcagccgtttttcaacttcagtttcattcactaccattgtttccaaattatcaatctctgctagtaattatgaatttaagaccatattattatcaaaaacctagagaccaatcatatatctgaaaagaaatacccattaaaaattctgcctcctgtttattgagaactatgcattgaacattctgaatcattctaagcctctggagagactgtaatgatccattcatgagctggtatgaaatcagtgggaagcagaacaacagaaggaactttaaaagcaacaagcaattatgtaccatatatacactgtagcaaatattttatatttgagagtctttacagcttacatttccattccattattacaagtgatgaaaaacaaaaaattgcaagtagtatgcaaattataaatatacagtcttcccacttcactaaccaaattcctactttccagtgttacttcccaatttatgcaggaaacctcctgcaaagctgaaactgattagaaaattctttatattttaaaatagctctttctcatttttagagaagtcaaatagccaaccatcaaaattaagaataaattgaattgtcacagtccattacagttattgttgctagatccacctcatttgcagatgtccaaacttaaattcatctgttcttaaaatgctacttaaaactttggttgttttcctgtaatataaaagaaaaagttaatttatcaattgattgaatacagtttttactaattagtttatcaaaccaaatactgtgaacgtaccaggtgtttacagatttaaatgcatgttaccatagaaactattaaagtaactagaactgtcaaataacaaaacggctcatgtttttaaaatatatgtaactcattttaaaatatattaaattgtattccaaacctgttcttctgtttctgtggcacctaggtttaaaatatgtattaatgtgtaaatcacaagtaaaatgaattctaatgtacaagtttgttttaaaaagtgtatgtcaagcttttatttacacaataaaatgttattaaagatggaaagtcta

SEQ ID NO: 5599 - DNA, 6921 bp, Homo sapiens
gggagatttggacgctccggcctgggaggtgcgtcagatccgagctcgccatccagtttcctctccactagtccccccagttggagatctgggaccaacaaggcaccatggcgcagaagggccaactcagtgacgatgagaagttcctctttgtggacaaaaacttcatcaacagcccagtggcccaggctgactgggccgccaagagactcgtctgggtcccctcggagaagcagggcttcgaggcagccagcattaaggaggagaagggggatgaggtggttgtggagctggtggagaatggcaagaaggtcacggttgggaaagatgacatccagaagatgaacccacccaagttctccaaggtggaggacatggcggagctgacgtgcctcaacgaagcctccgtgctacacaacctgagggagcggtacttctcagggctaatatatacgtactctggcctcttctgcgtggtggtcaacccctataaacacctgcccatctactcggagaagatcgtcgacatgtacaagggcaagaagaggcacgagatgccgcctcacatctacgccatcgcagacacggcctaccggagcatgcttcaagatcgggaggaccagtccattctatgcacaggcgagtctggagccgggaaaaccgaaaacaccaagaaggtcattcagtacctggccgtggtggcctcctcccacaagggcaagaaagacacaagtatcacgggagagctggaaaagcagcttctacaagcaaacccgattctggaggctttcggcaacgccaaaacagtgaagaacgacaactcctcacgattcggcaaattcatccgcatcaacttcgacgtcacgggttacatcgtgggagccaacattgagacctatctgctagaaaaatcacgggcaattcgccaagccagagacgagaggacattccacatcttttactacatgattgctggagccaaggagaagatgagaagtgacttgcttttggagggcttcaacaactacaccttcctctccaatggctttgtgcccatcccagcagcccaggatgatgagatgttccaggaaaccgtggaggccatggcaatcatgggtttcagcgaggaggagcagctatccatattgaaggtggtatcatcggtcctgcagcttggaaatatcgtcttcaagaaggaaagaaacacagaccaggcgtccatgccagataacacagctgctcagaaagtttgccacctcatgggaattaatgtgacagatttcaccagatccatcctcactcctcgtatcaaggttgggcgagatgtggtacagaaagctcagacaaaagaacaggctgactttgctgtagaggctttggccaaggcaacatatgagcgccttttccgctggatactcacccgcgtgaacaaagccctggacaagacccatcggcaaggggcttccttcctggggatcctggatatagctggatttgagatctttgaggtgaactccttcgagcagctgtgcatcaactacaccaacgagaagctgcagcagctcttcaaccacaccatgttcatcctggagcaggaggagtaccagcgcgagggcatcgagtggaacttcatcgactttgggctggacctacagccctgcatcgagctcatcgagcgaccgaacaaccctccaggtgtgctggccctgctggacgaggaatgctggttccccaaagccacggacaagtctttcgtggagaagctgtgcacggagcagggcagccaccccaagttccagaagcccaagcagctcaaggacaagactgagttctccatcatccattatgctgggaaggtggactataatgcgagtgcctggctgaccaagaatatggacccgctgaatgacaacgtgacttccctgctcaatgcctcctccgacaagtttgtggccgacctgtggaaggacgtggaccgcatcgtgggcctggaccagatggccaagatgacggagagctcgctgcccagcgcctccaagaccaagaagggcatgttccgcacagtggggcagctgtacaaggagcagctgggcaagctgatgaccacgctacgcaacaccacgcccaacttcgtgcgctgcatcatccccaaccacgagaagaggtccggcaagctggatgcgttcctggtgctggagcagctgcggtgcaatggggtgctggaaggcattcgcatctgccggcagggcttccccaaccggatcgtcttccaggagttccgccaacgctacgagatcctggcggcgaatgccatccccaaaggcttcatggacgggaagcaggcctgcattctcatgatcaaagccctggaacttgaccccaacttatacaggatagggcagagcaaaatcttcttccgaactggcgtcctggcccacctagaggaggagcgagatttgaagatcaccgatgtcatcatggccttccaggcgatgtgtcgtggctacttggccagaaaggcttttgccaagaggcagcagcagctgaccgccatgaaggtgattcagaggaactgcgccgcctacctcaagctgcggaactggcagtggtggaggcttttcaccaaagtgaagccactgctgcaggtgacacggcaggaggaggagatgcaggccaaggaggatgaactgcagaagaccaaggagcggcagcagaaggcagagaatgagcttaaggagctggaacagaagcactcgcagctgaccgaggagaagaacctgctacaggaacagctgcaggcagagacagagctgtatgcagaggctgaggagatgcgggtgcggctggcggccaagaagcaggagctggaggagatactgcatgagatggaggcccgcctggaggaggaggaagacaggggccagcagctacaggctgaaaggaagaagatggcccagcagatgctggaccttgaagaacagctggaggaggaggaagctgccaggcagaagctgcaacttgagaaggtcacggctgaggccaagatcaagaaactggaggatgagatcctggtcatggatgatcagaacaataaactatcaaaagaacgaaaactccttgaggagaggattagtgacttaacgacaaatcttgcagaagaggaagaaaaggccaagaatcttaccaagctgaaaaacaagcatgaatctatgatttcagaactggaagtgcggctaaagaaggaagagaagagccgacaggagctggagaagctgaaacggaagctggagggtgatgccagcgacttccacgagcagatcgctgacctccaggcgcagatcgcagagctcaagatgcagctggccaagaaggaggaggagctgcaggcggccctggccaggcttgacgatgaaatcgctcagaagaacaatgccctgaagaagatccgggagctggagggccacatctcagacctccaggaggacctggactcagagcgggccgccaggaacaaggctgaaaagcagaagcgagacctcggcgaggagctggaggccctaaagacagagctggaagacacactggacagcacagccactcagcaggagctcagggccaagagggagcaggaggtgacggtgctgaagaaggccctggatgaagagacgcggtcccatgaggctcaggtccaggagatgaggcagaaacacgcacaggcggtggaggagctcacagagcagcttgagcagttcaagagggccaaggcgaacctagacaagaataagcagacgctggagaaagagaacgcagacctggccggggagctgcgggtcctgggccaggccaagcaggaggtggaacataagaagaagaagctggaggcgcaggtgcaggagctgcagtccaagtgcagcgatggggagcgggcccgggcggagctcaatgacaaagtccacaagctgcagaatgaagttgagagcgtcacagggatgcttaacgaggccgaggggaaggccattaagctggccaaggacgtggcgtccctcagttcccagctccaggacacccaggagctgcttcaagaagaaacccggcagaagctcaacgtgtctacgaagctgcgccagctggaggaggagcggaacagcctgcaagaccagctggacgaggagatggaggccaagcagaacctggagcgccacatctccactctcaacatccagctctccgactcgaagaagaagctgcaggactttgccagcaccgtggaagctctggaagaggggaagaagaggttccagaaggagatcgagaacctcacccagcagtacgaggagaaggcggccgcttatgataaactggaaaagaccaagaacaggcttcagcaggagctggacgacctggttgttgatttggacaaccagcggcaactcgtgtccaacctggaaaagaagcagaggaaatttgatcagttgttagccgaggagaaaaacatctcttccaaatacgcggatgagagggacagagctgaggcagaagccagggagaaggaaaccaaggccctgtccctggctcgggcccttgaagaggccttggaagccaaagaggaactcgagcggaccaacaaaatgctcaaagccgaaatggaagacctggtcagctccaaggatgacgtgggcaagaacgtccatgagctggagaagtccaagcgggccctggagacccagatggaggagatgaagacgcagctggaagagctggaggacgagctgcaagccacggaggacgccaaactgcggctggaagtcaacatgcaggcgctcaagggccagttcgaaagggatctccaagcccgggacgagcagaatgaggagaagaggaggcaactgcagagacagcttcacgagtatgagacggaactggaagacgagcgaaagcaacgtgccctggcagctgcagcaaagaagaagctggaaggggacctgaaagacctggagcttcaggccgactctgccatcaaggggagggaggaagccatcaagcagctacgcaaactgcaggctcagatgaaggactttcaaagagagctggaagatgcccgtgcctccagagatgagatctttgccacagccaaagagaatgagaagaaagccaagagcttggaagcagacctcatgcagctacaagaggacctcgccgccgctgagagggctcgcaaacaagcggacctcgagaaggaggaactggcagaggagctggccagtagcctgtcgggaaggaacgcactccaggacgagaagcgccgcctggaggcccggatcgcccagctggaggaggagctggaggaggagcagggcaacatggaggccatgagcgaccgggtccgcaaagccacacagcaggccgagcagctcagcaacgagctggccacagagcgcagcacggcccagaagaatgagagtgcccggcagcagctcgagcggcagaacaaggagctccggagcaagctccacgagatggagggggccgtcaagtccaagttcaagtccaccatcgcggcgctggaggccaagattgcacagctggaggagcaggtcgagcaggaggccagagagaaacaggcggccaccaagtcgctgaagcagaaagacaagaagctgaaggaaatcttgctgcaggtggaggacgagcgcaagatggccgagcagtacaaggagcaggcagagaaaggcaatgccagggtcaagcagctcaagaggcagctggaggaggcagaggaggagtcccagcgcatcaacgccaaccgcaggaagctgcagcgggagctggatgaggccacggagagcaacgaggccatgggccgcgaggtgaacgcactcaagagcaagctcagagggccccccccacaggaaacttcgcagtgatgcaccaggcgaggaaacgagacctctttcgttccttctagaaggtctggaggacgtagagttattgaaaatgcagatggttctgaggaggaaacggacactcgagacgcagacttcaatggaaccaaggccagtgaataagcaactttctacagttttgcaccacggcaagaaaaccaaaaaccaaaacaaacaaacaaaaaaaacccaacaacaacccagaacaaagcaaaacccagcagactgtacttagcattgtctaaatccattctcaaattccaaatatcacagacacccctcacacaaggaatataaaaaccaccaccctccagcctgggcaacgtagtaaaacctcatctatacaagaatttaaaaataagctgggcgtggtggtacacacctgtggtcccagctactagggaggctgagccaggaagaacgctccagcccaggacttcgaggctgcaatgagctataattgcatcattgcactccagcctgggcaacagagaccctgtctcaaccaccaccaccaccaccacccctactacccctgtattcaaggtaaaaattgaagtttgtatgatgtaagagatgagaaaaacccaacaggaaacacagacacatcctccagttctatcaatggattgtgcagacactgagtttttagaaaaacatatccacggtaaccggtccctggcaattctgtttacatgaaatggggagaaagtcaccgaaatgggtgccgccggcccccactcccaattcattccctaacctgcaaacctttccaacttctcacgtcaggcctttgagaattctttccccctctcctggtttccacacctcagacacgcacagttcaccaagtgccttctgtagtcacatgaattgaaaaggagacgctgctcccacggaggggagcaggaatgctgcactgtttacaccctgactgtgcttaaaaacactttcactaataaatggttataaatcacaa

SEQ ID NO: 5600 - DNA, 2858 bp, Homo sapiens
aacagtattttccttttcaacacatctattgaaagtgttggataaatgcaggatgttaatatgctataaacataaagtctgtttttaaaaaatagcatttgaaaatcatgaagggctttttgttttcttttgtttgtatatatgtttattggtaacaggtgacactggaagcaatgaacaccacagtgatgcaaggcttcaacagatctgagcggtgccccagagacactcggatagtacagctggtattcccagccctctacacagtggttttcttgaccggcatcctgctgaatactttggctctgtgggtgtttgttcacatccccagctcctccaccttcatcatctacctcaaaaacactttggtggccgacttgataatgacactcatgcttcctttcaaaatcctctctgactcacacctggcaccctggcagctcagagcttttgtgtgtcgtttttcttcggtgatattttatgagaccatgtatgtgggcatcgtgctgttagggctcatagcctttgacagattcctcaagatcatcagacctttgagaaatatttttctaaaaaaacctgtttttgcaaaaacggtctcaatcttcatctggttctttttgttcttcatctccctgccaaatacgatcttgagcaacaaggaagcaacaccatcgtctgtgaaaaagtgtgcttccttaaaggggcctctggggctgaaatggcatcaaatggtaaataacatatgccagtttattttctggactgtttttatcctaatgcttgtgttttatgtggttattgcaaaaaaagtatatgattcttatagaaagtccaaaagtaaggacagaaaaaacaacaaaaagctggaaggcaaagtatttgttgtcgtggctgtcttctttgtgtgttttgctccatttcattttgccagagttccatatactcacagtcaaaccaacaataagactgactgtagactgcaaaatcaactgtttattgctaaagaaacaactctctttttggcagcaactaacatttgtatggatcccttaatatacatattcttatgtaaaaaattcacagaaaagctaccatgtatgcaagggagaaagaccacagcatcaagccaagaaaatcatagcagtcagacagacaacataaccttaggctgacaactgtacatagggttaacttctatttattgatgagacttccgtagataatgtggaaatcaaatttaaccaagaaaaaaagattggaacaaatgctctcttacattttattatcctcgtgtacagaaaagattatataaaatttaaatccacatagatctattcataagctgaatgaaccattactaagagaatgcaacaggatacaaatggccactagaggtcattatttctttctttctttttttttttttttaatttcaagagcatttcactttaacattttggaaaagactaaggagaaacgtatatccctacaaacctcccctccaaacaccttctcacattcttttccacaattcacataacactactgcttttgtgccccttaaatgtagatatgtgctgaaagaaaaaaaaaacgcccaactcttgaagtccattgctgaaaactgcagccaggggttgaaagggatgcagacttgaagagtctgaggaactgaagtgggtcagcaagacctctgaaatcctgggtaaaggattttctccttacaattacaaacagcctctttcacattacaataatataccataggaggcacaagcaccattattaagccactttgcttacaccttaagtgtgtacaattcaagtgtgagaatgctgtgttaactattctttggaattctccttctgtccagcaaatactctaatgatggttaaacatggcacctactcagcaatgccttcctggaccacaacccctatccccctgccccaccctcctcattaaaaacaaatacttctactgtttgggtgtgtgatagggttctcaatgcagatctcccttttctagttagctatattcttgactgcatccgctaaaaatgttaaagcttcttgagagacagacatgccagattttcttggtatctcccataatacgacctacagtccatggtctacagatgttttaaatagaattgctattctcgatacatacaaagacgtaattgctgacccacaatcagtaacatccatattgagagatttttcaaaggatggtgaccctgcttgtatttatttaccttggtattttttcttgcatccttctgtgattcaaaaaagtaaaatgtggctttctgaaatgatggataagagtctacatcttctagaaaaaatacataaaggagtagttaagctctgtaaatgtgccacgagctccaacacgaccatcgtagggtgaagcccacgttttcttccatggcctcaaaggccctagaacttgcctacctttctggccttacctcctagctacttatccatctcttgaactttatactcttgtataaatttctaactttcagaaaatgccatactctgttttggcaccacacatgtatatttccccctggtacacttggaagactcttatccatctgtgaaaccctatgttgtcatcacttggtccatgaaatattacctggccaatatcccaccatcacctcaaacccaatcaccccctcctctgtatgctgtcacacctatattattaaacttatcacattgcattgtaattacttcctgacctttgtatctactcttttagtaactgatgtatatatctgaaaggagagattgtttcattgtgcaatcaataaatgtttgataaaataaagccc

SEQ ID NO: 5601 - DNA, 2912 bp, Homo sapiens
aatcgcgcccgctccgacgtgtccaggtccgcggccccgggagcttggcgcggcccggcctggatgcgctgggcggagggtgcaggggagggcacggcgccgcttgcttggcctgcgcacccggacctagaagccgggacgagccggggcagagccaggcgcgcggaagtctgaaggtgccctccagacacggccccgatgactgaactacagcaagatgtggaagacacaaagcctgcgaaagtgctcgggaagagggagagcaaacttggctcagcccactcagaggctgagaatggtgtggaggagaaaaagaaagcctgcaggtcgccaacagcccaatcccctaccccatctgtggaggcggactccccagaccagaagaaaatcattagcctatggtcaaaatccagttttgatggtgcctctttagcaagtgataagaacgactgtaaaacagaaagcaaaaatgaccctaagactgaaagaaaaaagtcttcatcttccagccagtacaaggccaatatgcactttcacaagttgtttcttagtgtcccaacggaggaaccactgaagcaaagctttacctgtgctctacagaaagaaatactataccaaggaaagctctttgtatcagaaaactggatttgttttcattccaaagtctttggaaaagacacaaagatctctattccagctttctcggtaaccctaataaagaaaaccaaaactgctcttctagtgccaaacgccctgatcatagcaacagtcacagacaggtacatatttgtctccttactctccagagattcaacttacaaactactaaaatctgtgtgtggacacttagaaaatacaagtgttggtaacagtcccaatccatcttctgctgaaaacagtttccgagcagaccgcccttcatctctgcctctggatttcaatgatgaattctcagatctggatggagtggttcaacgaagaaggcaagacatggaaggatatagtagttctggttctcaaactcctgaatctgagaactctcgagatttccatgcgacagaatcccaaacagttctgaatgtctccaagggagaagcaaagccaactcgggcagatgcccatgtgaacagagtacctgaaggaaaagccaagagtctccctgtacagggtctgtcagaaactgttggaatcttacataaagtcaagtctcagaaatgtccgatgcttcaccatattcttatattctatgcaattgttgtctgtgcactaatcatctcgaccttctacatgagatacagaattaatactctggaggagcagctggggttactaacctccattgtggacacccataatactgaacaggcagcaccatctggcctgaggtcacaagtacaattcaatgtggaggttctctgtcaagagcttacagctaacatagtgaaattagaaaagatacaaaataacttacagaagttgcttgagaatggtgactgatcgaccagattgcttgggccatcggaatacctcatgtttccctttgaagaaggtgcttcccgaggcgttttgtttgagtgcaccctgctggtcagaggtgcaagcagatgagaatccagacattgcatgtggaggtctccagctcaggaaagtggggagggaaataattttggttcttgtgcaataaaagttgaccttgactctctgaggaagattttgctgcttttgcctgaagaaaacagacccatctctggaggtctcaggaagggcccagcgaacacactctcttggataattaccacgatggcgtcagcaaacactccaccctgtgcctttttagtccttcccgccctcctgcctctcccttacacccctcttaacgactttcaaactaaaggatacatcatatactgacaaactcaatgtggtcctttcaagaattagccatgagtctcaaaaaggcaataaatggctctaagtggacaggtttgcttcaaacaagtaacatctacattttgtcttttttttttcagttctcctgttatgttctggttgaaatcacctgtgtgtcttaatttctcaattcctttttggcaagaatatcaagcaaggtgaatttaacattatgtttatgttttgttttgttgctgtaactaatagttaattggactgattcttacccagccctggtcaagaatctgtgaggcatgtgactgaagtactaaattaaacttattttgaaaccaaacctaatttttaagccaaaaggtgtaatagtgatttaatacaggatgaaaaacactgaatttttaagactgtaggtggactatgttagtagttttcaagcaggatgtctgtattcagcattcaataatgctaaaatccctttcagcatgaaatttgtatgtttttatcctttgctgactaaaataaaataactggtggtttgctaactatttaccatatgggttggctggtttttattaataattgtttagggtatcataagatctgtaagtacaaaggatattctgtttctatctgcaatgcatttgataatcatttctatgaaatgtattttatttaatcagataagctaataagcgaattggttacatcgtttgtatctgttggcctagtggacagctgtgcctggtgcacctctggcttttaataaatactcattggttgaaacaccctgctaacactgtgttttgtcagttcgtaaattcctttaaccaagacttaactatgctttttaactctttttccacctgccatctactactaccaactcacttatacttccttcctcccaagtaatcatttcaaaactaaaaaaggatttaagttcttgggttacaacggtttaaaggaaagaaaatgaactttgaagtcaaaaaaaaaaaaaaaaa

SEQ ID NO: 5602 - DNA, 2220 bp, Homo sapiens
gaacttctttcctggcacaggactcactgtgccccttcccgctgtgggtacaaggtctgccccccaccccagctctccaaagcccaccggcctccctggaggccgaggtcgacggcccgtcgcaccgggagggggggctcccaggggtgccccacgcacggtcaaggtcccgcgccaagcggggaccgggctgggccggaagcgggcacggtactcgcggcaaactagcgtgggcgagtcctgattgcagtcggacctgccgccgcggcacttaacagtttgcagagtgcttcccgcccctgatctcattggagccttcggacagcccagcccatggccaccgatgcccccatttcacgcctgaggaagcggaggctcagacgggccaccagcccctccggaggctggcccgggagcgcctggcagcgtcgggtctaggagccggctccctcctgctccctcctccgcgccgcccggggtgtgcccgccgtctgtgtgcaccactgctgagcccagctccggcgccctcgcctctgctgtgggccccggggacgcggggtcaggccaccgcgttggccaggccgctgcaggtaggcacggcccccaccaggcgccatggactggaagacactccaggccctactgagcggtgtgaacaagtactccacagcgttcgggcgcatctggctgtccgtggtgttcgtcttccgggtgctggtatacgtggtggctgcagagcgcgtgtggggggatgagcagaaggactttgactgcaacaccaagcagcccggctgcaccaacgtctgctacgacaactacttccccatctccaacatccgcctctgggccctgcagctcatcttcgtcacatgcccctcgctgctggtcatcctgcacgtggcctaccgtgaggagcgggagcgccggcaccgccagaaacacggggaccagtgcgccaagctgtacgacaacgcaggcaagaagcacggaggcctgtggtggacctacctgttcagcctcatcttcaagctcatcattgagttcctcttcctctacctgctgcacactctctggcatggcttcaatatgccgcgcctggtgcagtgtgccaacgtggccccctgccccaacatcgtggactgctacattgcccgacctaccgagaagaaaatcttcacctacttcatggtgggcgcctccgccgtctgcatcgtactcaccatctgtgagctctgctacctcatctgccacagggtcctgcgaggcctgcacaaggacaagcctcgagggggttgcagcccctcgtcctccgccagccgagcttccacctgccgctgccaccacaagctggtggaggctggggaggtggatccagacccaggcaataacaagctgcaggcttcagcacccaacctgacccccatctgaccacagggcaggggtggggcaacatgcgggctgccaatgggacatgcagggcggtgtggcaggtggagaggtcctacaggggctgagtgaccccactctgagttcactaagttatgcaactttcgttttggcagatattttttgacactgggaactgggctgtctagccgggtataggtaacccacaggcccagtgccagccctcaaaggacatagactttgaaacaagcgaattaactatctacgctgcctgcaaggggccacttagggcactgctagcagggcttcaaccaggaagggatcaacccaggaagggatgatcaggagaggcttccctgaggacataatgtgtaagagaggtgagaagtgctcccaagcagacacaacagcagcacagaggtctggaggccacacaaaaagtgatgctcgccctgggctagcctcagcagacctaaggcatctctactccctccagaggagccgcccagattcctgcagtggagaggaggtcttccagcagcagcaggtctggagggctgagaatgaacctgactagaggttctggagatacccagaggtcccccaggtcatcacttggctcagtggaagccctctttccccaaatcctactccctcagcctcaggcagtggtgctcccatcttcctccccacaactgtgctcaggctggtgccagcctttcagaccctgctcccagggacttgggtggatgcgctgatagaacatcctcaagacagtttccttgaaatcaataaatactgtgttttataaaa

SEQ ID NO: 5603 - DNA, 1858 bp, Homo sapiens
ctccccgcgcctttaatactcgcccgctgcggcggtcgccgagtccgcggacatgtccttcccgcagctgggctacccgcagtacctgagcgccgcggggccgggcgcctacggcggcgagcgcccgggggtgctggccgcggccgctgcggcggctgccgccgcctcgtcgggccgaccgggggccgcggagctgggcggcggggcaggcgcggctgcagtcacctcggtgctgggcatgtacgcggcggcggggccgtacgcgggcgcgcccaactacagcgccttcctgccctacgccgcggatctcagcctcttctcgcagatgggctcgcagtatgaactgaaggacaaccctggggtgcaccccgccaccttcgcagcccacacggcgccggcttattacccctacggccagttccaatacggggaccccgggcggcccaagaacgccacccgcgagagcaccagcacgctcaaggcctggctcaacgagcaccgcaagaatccctaccccaccaagggcgagaagatcatgctggccatcatcaccaagatgaccctcacgcaggtctccacctggttcgccaacgcgcgccggcgcctcaagaaggagaacaaggtgacatggggagcgcgcagcaaggaccaggaagatggagcgctcttcggcagcgacaccgagggcgacccggagaaggccgaggacgacgaggagatcgacctggaaagcatcgacattgacaagatcgacgagcacgatggcgaccagagcaacgaggatgacgaggacaaggccgaggctccgcacgcgcccgcagccccttctgctcttgcccgggaccaaggctcgccgctggcagcagccgacgttctcaagccccaggactcgcccttgggcctggcaaaggaggccccagagccgggcagcacgcgcctgctgagccccggcgctgcagcgggcggcctgcagggtgcgccgcacggcaagcccaagatctggtcgctggcggagacagccacgagccccgacggtgcgcccaaggcttcgccaccaccacccgcgggccaccccggcgcgcacgggccctccgccggggcgccgctgcaacaccccgccttcctgcctagccacggactgtacacctgccacatcggcaagttctccaactggaccaacagcgcattcctcgcacagggctccctgctcaacatgcgctccttcctgggcgttggcgctccccacgccgcgccccatggccctcaccttcctgcacctccaccaccgcagccgccggtcgctattgccccgggggcactcaatggagacaaggcctcggtccgcagcagccccacgctcccagagagagacctcgtccccaggccagattcgccggcacagcagttaaagtcgcccttccagccggtacgcgacaactctctggccccgcaggagggaacgccgcggatcctagcagccctcccgtccgcctgattaagggtcttcttttacttttgcgggggggaggggggaggagttggggagggagggaatgtgggaggaattaagacaaatatttcagactggtgtaaaggacaaatatgacaacgacgtcaaggactcgcatccgtcgctttctgcagaaaggggcttcttcggtcccgagctcgcgtccaggtggccaggcctctgccggcggctccagtggctgcgattatcgggttcggtaaatgcccccacgtgcttgtgtctctttccccccttttctgtatatagagtggtttcagattgtaaatagcgcgtcagcgaacttgtctaaatcatatatttttgtctaataaactaaatgaaatgaca

SEQ ID NO: 5604 - DNA, 2907 bp, Homo sapiens
ggttggcgtctgcacctgcgaccaccgtgagcagtcatggcgtactccacagtgcagagagtcgctctggcttctgggcttgtcctggctctgtcgctgctgctgcccaaggccttcctgtcccgcgggaagcggcaggagccgccgccgacacctgaaggaaaattgggccgatttccacctatgatgcatcatcaccaggcacactcagatggccagactcctggggctcgtttccagaggtctcaccttgccgaggcatttgcaaaggccaaaggatcaggtggaggtgctggaggaggaggtagtggaagaggtctgatggggcagattattccgatctacggttttgggatttttttatatatactgtacattctatttaagctctcaaaggggaaaacaactgcagaggatgggaaatgctatactgccatgcctggaaacacccacaggaaaattaccagttttgagcttgctcaactgcaagaaaaactgaaggagacagaagcagccatggaaaaattattcaacagagtgggacctaatggtgagagagcacagactgtgacttctgaccaagagaaacggttgctacatcagctccgagaaatcaccagggtcatgaaagaaggaaaattcattgacagattttctccagagaaagaagctgaggaggccccttacatggaggactgggaaggttaccctgaagagacttacccaatttatgacctttcagactgtatcaagcgtaggcaagaaacaatcttggtggattaccctgacccaaaagaactttctgctgaagaaatagctgaaagaatgggaatgatagaagaggaagaatcagatcatttgggttgggaaagtctgcccactgaccccagagcccaggaagataattctgttacctcgtgtgatccaaagccagaaacatgttcctgctgttttcatgaagacgaggatcctgctgtcttggcagagaatgctggattcagtgcagatagctaccctgagcaagaggaaaccaccaaagaagagtggtcccaagactttaaagatgaagggttgggcatcagcacagataaagcatatacaggcagcatgctgaggaagcgtaacccccagggtttagagtgaaaacagccagtctgaagtatccattactcaagtcccaaggtgacctctctctcctcagatttccttcttggccctgtgccctgcactttcttcactgtgttcaagtgtcatagctatcaggccactatcatggatatcatgtatccttcctggtgctcacacacctgtcaccttgtaaaacacggacattagtgtgaacacaggacagcttcgctctttctcttcctgcctttcctctatcagagaagttgatccattaagtaattatgtttggtctattgtaattacagatgggaccactcaggggcaaaggtctgactcttcctggtaggtgtaacagatagttcacctgtgaacgaacatcagcttacagatgatgaggacttaaggttgcaagaatgaagatttcagactccaagatcccttattctttgggccttgagcaggttagtagtcccctggtgagaagagaacattttgtttgtggggctaatgggcccagaggagggtaagactctgctgtctaagctgaagcctcttcctcgcagcgagggtcttcctaggaacattgatgctacctcagacatcctcttttctccagagtagggaagactcccactgatctgagaatgagcccagaggcttgtttggggactgttttactctgatactacctggatatctagcttcctttacccctgttctgcttaacagaactgccaagcccagaagtacctttgcactcctggttttcagtggacagaggaagctttagatagagactttagaccctgccctgcagagtcaagacttgaggccattgaagctgcaggaagccctgcccagggatggtcctgccatgaggaggctgcaacgctataagagggctcaagattgtgaattctgctcctgccatgaggagctcagaaggccaggaagccagcaataggggagagaatctgtgtgcttatggacagtccttacctaaagctgtttctgaatgttgcaccctttgagaaatttcttctcagaaccataaattgaaacaaatgaggactgatcttgtatacaaagtgccaactcaagagggaagttggagtatgtctgttgcagagaaccgatatagcagtgcccaggggtagagaccatgtgttccatactcggatatttgggtctttttgagagagctggggaaagtagcagcaactagattaagactgggaggattttgaccaaactaaaggccttttctccttactgcatctgacgtgtgtcttcttgagacaagatagcacccatgaattacatcatgaggtatgtgtgaattcagtttacatgtaagacctgagagttcgaagagggcacattcccaaagacattcccagtcatgaaatgtagaagactggaaaattaagacattatgtaaaggtagatatggcttttagagttacattatgcttggcatgaataaggtgccaggaaaacagtttaaaattatacatcagcatacagactgctgttagaaggtatgggatcatattaagataatctgtcagctactactaggcatttattgttaattgagttacagaaagtcattcaagactgagtttatagaaagcatattgcatctatctctgtgtagaacatttgattcacattgtgaagaatgcagtttaaaatatactgaatgcaatctagatgtattgtacacgaaaggtgaaaaataacaggtgctctttactgtttaaaaaaaaaaaaaaa

SEQ ID NO: 5605 - DNA, 1755 bp, Homo sapiens
cgcgagggtgcctgtccgccgctcgccgcgctgaggcagtgcggggcgggcgcgcctaggctgccgcccagcgccctcgccgcggccatgcccgggccctagagcgcctgccgcagcttgcgccccgcagccccgcagccccgcgcccgccgccgcctcttcaatgggcaacctgctcggcggggtcagcttccgcgagcccaccaccgtggaggactgcgactccacctggcagaccgactcggagcccgagcccgaagaaccagggccgggcggcggcagcgagggcccggggcaggagtccgagcagcccgcgcagcccccggagcaagccggcgggcggcccggcgccagccccgcgccggacgaggacgccgaggcggcgggcgccgagcagggtggtgattccactgaagcaactgccaaaccaaagagaagtttttatgctgccagggatttgtacaagtaccgacaccagtacccaaacttcaaagatatccgatatcaaaatgacttgagcaatcttcgtttttataagaataaaattccattcaagccagatggtgtttacattgaagaagttctaagtaaatggaaaggagattatgaaaaactggagcacaaccacacttacattcaatggcttttccccctgagagaacaaggcttgaacttctatgccaaagaactaactacatatgaaattgaggaattcaaaaaaacaaaagaagcaattagaagattcctcctggcttataaaatgatgctagaattttttggaataaaactgactgataaaactggaaatgttgctcgggctgttaactggcaggaaagatttcagcatctgaatgagtcccagcacaactatttaagaatcactcgtattcttaaaagccttggtgagcttggatatgaaagttttaaatctcctcttgtaaaatttattcttcatgaagctcttgtggagaatactattcccaatattaagcagagtgctctagagtattttgtttatacaattagagacagaagagaaaggagaaagctcctgcggttcgcccagaaacactacacgccttcagagaactttatctggggaccgcctcgaaaagaacagtcggagggaagcaaagcccagaaaatgtcttcccctctcgcctccagtcataacagtcaaacttctatgcacaaaaaagccaaggactccaaaaattcctcctcagctgttcatttaaatagcaaaacagctgaagacaaaaaagtggcaccaaaagagcctgtggaagagacagacaggcccagcccagagcccagcaatgaagctgccaagccaagaaatacagagaaggacagtaatgctgagaacatgaattctcaacctgagaaaacagttactactcccacagaaaaaaaggagagtgtatctcctgagaataacgaagaaggtggaaatgataaccaagacaatgaaaatcctggaaatacaaattgccatgatgttgtactagtacagtgaattatcagaaaacccagaagccagtttaggctagagaggaaaaaactactgtatcatttatcctaaagaacagagatgaggtcaatttcaaattttagccatctgtttgtgatttctgtcataagcattttgttgtttgtttttttattttggatgacaatgaattgaatatctaataaggagatttaagataagacccaataaatgaatgtattctgtaaaaaaaaaaaaaaaaa

SEQ ID NO: 5606 - DNA, 4307 bp, Homo sapiens
gccgaggcctgcgcgccgcccggccgcctgcactgcgcgcgcgcccaccccgcgtgggaggcagcgggaggggcccggagaggtgtggagcggcgcggcgggaggctccgtgggcggccacgggagacagcgccggcgggagcgcgcctctcggcctttcctccgcgcccccgcgtccccagccggccgctccgagaggacccggaggaggcaggtggctttctagaagatgaccatagaggaccttccagattttccattagaaggaaatcctttgtttggaagatacccatttatattttctgcttctgataccccagttatcttttccatttctgcagcaccaatgccttcagactgtgaattttctttctttgatcctaatgatgcatcatgccaggaaattctttttgatcccaaaacttcagtttcagaattatttgccattttgagacagtgggttcctcaggtccaacaaaacattgacattattggaaatgagattcttaagagaggttgcaatgtgaatgatagagatggattgacagatatgactcttttacattatacctgcaaatctggagctcatggtattggtgatgtggaaacagctgtaaaatttgcaactcagcttattgacctgggagcagacattagtttgcggagtcgctggacaaacatgaatgctttgcattatgctgcttattttgatgtccctgaacttataagagtgattttgaaaacgtcgaaaccaaaagatgtggatgccacttgcagtgattttaattttggaacagctttgcatattgcagcatacaacttgtgtgcaggtgctgtgaagtgcctcttggagcagggagcaaatcctgcatttaggaatgacaaaggacagatccctgctgatgttgttccagacccagtagatatgccgttagagatggctgacgccgcagccactgctaaggaaatcaagcagatgcttctagatgcggtgcctctgtcatgtaacatctcaaaggccatgctcccaaattatgatcatgtcactggcaaggcaatgcttacgtcacttggcctgaagttgggggatcgtgttgttattgcaggacagaaggttggtacattaagattttgtggaacaactgaatttgcaagtgggcagtgggctggcattgaactggatgaaccagaaggaaaaaataatggaagtgttggaaaagtccagtactttaaatgtgcccccaagtatggtatttttgcacctctttcaaagataagtaaagcaaaaggtcgaaggaagaatataacacacactccttctacaaaagctgctgtacctctcatcaggtcccagaaaattgacgtagctcatgtgacgtcaaaagtaaatactggattaatgacatcaaaaaaagatagtgcttctgagtcaacactttcattgcctcctggtgaagaacttaaaactgtgacagagaaagatgttgccctgcttggatctgtcagcagctgctcctctacatcttctttggaacacagacagagctaccccaagaaacagaatgcaatcagcagtaacaagaagacaatgagcaaaagcccttccctttcatccagagccagtgctggtttgaattcctcagcaacatctacagcaaataatagccgttgcgagggggaactccgcctcggagagagagtgttagtggtaggacagagactgggcaccattaggttctttgggacaacaaacttcgctccaggatattggtatggtatagagcttgaaaaaccccatggcaagaatgatggttcagttggaggtgtgcagtattttagctgttctccaagatatggaatatttgctcccccatccagggtgcaaagagtaacagattccctggataccctttcagaaatttcttcaaataaacagaaccattcttatcctggttttaggagaagttttagcacaacttctgcttcttcccaaaaggagattaacagaagaaatgctttttccaaatcgaaagctgctttgcgtcgcagttggagcagcacccccaccgcaggtggcattgaagggagcgtgaagctgcacgaggggtctcaggtcctgctcacgagctccaatgagatgggtactgttaggtatgtgggccccactgactttgcttcaggtatctggcttggacttgagctccgaagcgccaagggaaaaaatgatgggtcagtgggtgacaagcgctatttcacctgtaagccgaaccatggagtcttagttcgaccgagcagagtgacctatcggggaattaatgggtcaaaacttgtggatgagaattgttaagcttctaaaatattaaataagctcaaatatatatatttggtgtaaataaagagtccatggtaaatggtttactttatttagccatattaaaattttgaaaatatagttatcttcttaaaaaccattataacaattcagagagagttctttacaaagccatgaatatgaactatggggaatcatggttcttttaaagcaattttcaaaataagtaccaattaaagctttaggttccaagaagattctgggactcaggaagaaaaagtgccatcaggtgaccagctgttgcatttcttgcttattctgttttgtttttgcacatcataatggatttttcttagtgccctaattgtgaagggtttctctagctttggttatgtgtaatgttcacgtgacctttttttgtcaatcatttttggaatttttctttctttctgtgctttattactaataagtccaatgagtgagtagtagctagatgactagtatgtagttttatattttggtaaaattatttgccctttcagaaatgcctcatctaaagatacatgataattttggagttggaaggggccttagaggctctccagctctgcttcttgcccattgccaaatactgaaatggaagcccgtcttacctggggtcactaactggttggttaactgagctaagaatagactgtgggtctcctcacttgtggcccagtgctctttctgctatacaaaatgcctaatctcagatttttcttctgctgcttgactgcttcatctggatgaactacaaaaaacccatgattaaggtttatgaattcaagtaataattagattttttttgcacagacttacttaacttccttattggatatgtttgtaacacataaacacaaagcacttttcaaacatgatgcacttttatctttgtgaataatttactgtcctttcctcctgggatatgagaaacattttaaaaaacgtatttaacagaagagagcaaataaagatatatcaggaaggatgtattagttatttacttaaatgtttataatatctggattttttttgttttgttactcatagaactggtgttgtttgctgtttttatttctctaattgttgcagagttctgcctgttacaaagctacagaactgtattgtttttattttccttcttgagcacatgttaacaaactaagcttcacattagagtgatgtcataatgtaaaatgtttgcattgtggttaggtattgaagtttatgtcctgtctgtgtaaagattcatcttttattgtaaatatttagactttaccacagaaatattggaacagtttgctttataagattaaaaagcatccttcagaatggagcttgccttgtgcttagaaataatatgttgaactattttgcaatatactatttttaaatctaaattctgtcacttcgctgcctttttaaaatagtgtggtatttcaaatattgctagagctattttcctgaaatacatttgcaaaataaggctgctttgtaatcaaggaatatttttattgattgaaggaaatgactgtactgcgattcaaaagtaaacttattttattatacagattatttcttaaaaactctatttataccttaacatgaaatccatgaccacaccaaacttggttattcataatttttcctgttaaatataaaacactgtaagttaaaaacagtaatgccaacattgaatttatttttgaggtcaaagaaccagttgttctctttatatttagatgaggatgattgagtccatatactatgtatgtttacatatactatacatgcacattaggtgttttcatttgtgttttgcttatgaaatgtcatttaaagttcacttcttgagcatcaataaaaagggaagctgtgtggttttggaaaaaaaaaaaaaaaaaaaaaaaaagaaaaaaaaaaaaaaaaaaag

SEQ ID NO: 5607 - DNA, 2726 bp, Homo sapiens
cggcacgaggctggttgccggggcaggggcggaggcggaggcagaggtggaggcgctttgaaagccgtcattgtgtggcactggacggggaatcaagagacccggtttctaatccctgctctgtcactaacaagctgcgtgatcttcggaaaaaagtaatcctcttggaaagctggaaacatagtccgaagcttaagtgaaaatgatacatgttagaagacatgaaacaaggagaaattctaagagtcacgtgcctgagcagaaatctcgagttgattggaggcgaactaaaagaagtagtatctcacaattacttgatagtgatgaagagcttgatagtgaagaatttgatagtgatgaagagcttgatagtgatgaaagttttgaaaatgatgaagagcttgatagtaacaagggacctgattgtaataaaacaccaggaagtgaaagagagctcaacttaagtaaaattcaaagtgaaggaaatgacagtaagtgtctcattaactctggcaacggttcaacatatgaagaagaaacgaacaaaatcaaacataggaatattgacttacaagatcaggaaaaacatttaagtcaagaggataatgatctcaacaaacaaactggacaaataatagaggatgatcaggaaaaacatttaagtcaagaggataatgatctcaacaaacaaactggacaaataatagaggatgatttagaagaagaagacatcaagcgaggaaaaagaaaaaggctatcctctgtgatgtgtgacagtgatgagagtgatgacagcgatatcctagttagaaaagtaggtgttaaacgtccccgtagagtggttgaagatgaaggttcttcagtggaaatggagcaaaagactcctgaaaaaacattagctgcacaaaagcgagaaaaacttcagaagctcaaagaactctcaaaacaaagatctcgtcagagacgcagtagtggtagagattttgaggactctgaaaaggaatcttgcccaagcagtgatgaagttgatgaggaggaagaagaggataattatgaatctgatgaagatggagatgattatattatcgatgactttgtagtgcaagatgaggagggtgatgaagagaataaaaaccaacaaggagaaaaattgactacatcacaactgaaattagtaaaacagaattctctttattcttttagtgaccactatactcattttgaaagagttgtgaaggctcttctgatcaacgctttagatgaatcttttctgggaacattatatgatggcacaaggcaaaaatcatatgcaaaagatatgctaacatctcttcattatttggataaccgctttgttcagcctcgtctagagagcttggtatctagaagtcgttggaaagagcaatataaggagcgagtagaaaattattctaatgtaagtattcatttgaagaatcctgaaaactgttcctgccaggcttgtggactgcatcgctactgtaaatattcagtgcatttatcaggagagttgtataacaccaggaccatgcaaatagataatttcatgtcacatgataaacaggtgttcactgttggcagaatttgtgccagccgtaccagaatttatcataaactgaaacattttaaattcaaactataccaggaatgttgcaccattgcaatgacagaagaagttgaagatgaacaagttaaagaaacagtggaaagaattttcaggcggtcaaaagaaaatggctggattaaggagaaatatggtcaacttgaagaatatctcaattttgcggattactttcaagaagagaagtttgagttgtaacacatttccatcagagaagattttttaaattcctgtaaatgtgaagatcatgattcttgtttttctgtatcatgtgacatgtttgtacattttatctatatcttcatggcaaaatattttgtttaaaacatgattatcttaattcctgtgaagtggcactctacactctaattaaacttttatctgatgtacataaaagcattatcttaatttttaagtctgtaaatatattttaaagttatataataatggctttataacagatgactgtcaagtgaatgagctgttgatatcctgtcagtttagtcaaaatatattgtatcttaaaaatgtatttagactaacgtctacatgtatttttacggaattcctggccagatctgtttattcttttacagtattaaatgattttcactaatatattttttactgctatcatctaaatcagtgggccatggaagaaacctcatatatcattcagttcaatcccattgcttcagaatcagatcatagcatatctattctaagtagaggaatgcttttttccttttcttgaaagtttctctttcaaatagatttcaggcctctagagtctttcaaccctcacattcaggaataattttatgtaaattttcatgctttataatgttcttacttttttctattcaattttgtctatatattgatgattaagatgtattttatttatttttatccatagctttttccatataagtatgtatcttagggtcagaactgctgaaagagacaaactcagccaaaaacacttggaaagcatattttggtatctgcattgctttgcatatctaaattttcccataaagtaataaagtaaaatggttgcagaggaaaaaaaaagaaaaaaaaa

SEQ ID NO: 5608 - DNA, 5679 bp, Homo sapiens
gcttttctccttggcatggtcacggaatggatacctgtttgatcttcctgcactgctgagaaatcttccttttgggggagaggattaagtctgggttgaggtaggccacctgttgagacctggtgaaagatcaggtataataatgttctgcagtgaaaagaaattgcgtgaagtggaacggatagtgaaagccaatgaccgtgaatataatgaaaagttccagtatgcggataatcgtatccacacatcgaaatataatattctcaccttcttgccaattaatttatttgaacagttccaaagagtggcaaatgcctattttctttgccttctgattttacagctaattccagaaatttcctccttgacctggtttaccaccattgtgcctttggtcctggtgataactatgacagctgtcaaagatgccacagatgactattttcgccacaagagtgataatcaagtgaataatcggcagtctgaagtgctcatcaacagcaaactgcagaatgaaaaatggatgaatgtcaaagtgggagacatcattaaattagaaaataaccaatttgttgctgctgatttacttctcctatcaagtagtgagccacatggtctctgttatgttgaaactgctgagcttgatggggaaacgaacctaaaagtccgccatgcactatcagttacttcagaacttggagcagatatcagcagacttgcagggtttgatgggattgttgtctgtgaggtgcctaacaacaagttagataaattcatgggaatcctttcttggaaagacagcaagcattccctcaacaatgagaagataatcctgagaggctgcatcctgagaaataccagctggtgttttggaatggttatttttgcaggtcctgacactaaactaatgcagaatagtggtaagacaaagtttaaaaggacaagcattgatagattgatgaatactctagtactatggatttttgggtttctgatatgcttgggaattattcttgcaataggaaattcaatctgggagagtcaaactggggaccaattcagaactttcctcttttggaatgaaggagagaagagctctgtgttctccggattcttaacattctggtcatatattattattctcaatacagttgtacccatttccttatatgtgagtgtggaagtaattcgtctaggacacagttattttataaactgggaccggaagatgtattattctcgaaaagcaatacctgcagtggctcgaacgaccacgctcaatgaggaactggggcagattgagtacattttctccgacaaaacgggtaccctcactcaaaacatcatgacctttaaaagatgttccattaatgggagaatctatggtgaagtacatgatgacctggatcagaagacagaaataactcaggaaaaagagcctgtggatttctcagtcaaatctcaagcggatagagaatttcagttctttgaccaccatctgatggaatccattaaaatgggtgatcccaaagttcatgaattccttaggttacttgctctctgccacactgtaatgtcagaagagaatagcgcaggagagctgatttaccaagttcagtcacctgatgaaggggctctagtgactgccgctagaaattttgggttcatttttaaatcccggaccccagagaccataacaatagaagaattgggaacactagttacttatcaattacttgcctttttggatttcaacaacaccagaaaaaggatgtctgtcatagttcgaaacccagaaggacagataaagctttattccaaaggagcagatactattctgtttgaaaaacttcatccttccaatgaagtccttttgtctttgacgtcagaccacctcagtgaatttgcaggggaaggccttcggaccttggccatcgcatacagagacctggatgacaagtactttaaagagtggcataagatgcttgaagatgcgaatgctgccacagaagagagggatgaacgaatagctgggctatatgaagaaattgaaagagatttgatgctactaggtgccactgctgtagaagataagttacaggagggtgttattgaaacagttacaagtttatcactagccaatattaagatctgggtcctaacaggagacaaacaagaaactgccatcaacatcggttatgcctgcaacatgctgactgacgacatgaatgatgtgtttgtgatagcagggaataatgctgtggaagtgagagaagaactcaggaaagcaaaacaaaatttgtttggacaaaacagaaatttttccaatggccatgtagtttgtgaaaaaaagcagcagctggagttggattctattgtagaagaaaccataacaggagattatgccttaatcataaatggccacagtttggctcatgccctagaaagtgatgtcaagaatgatctcctagaacttgcttgcatgtgtaagactgtaatttgctgcagggtcactccactccagaaagcccaagtggtagagctggtgaagaagtacagaaatgctgttactttggccattggtgatggagccaatgatgtcagcatgattaaaagtgctcacattggtgttggcatcagcggccaggaaggattgcaagcagtcttagccagcgactattcatttgcacagtttagatatctccaaaggcttctccttgttcatggaaggtggtcttatttccgaatgtgcaaattcttatgctatttcttctataagaattttgcatttacacttgtgcatttctggtttggtttcttctgtggtttctcagcccagactgtttatgaccagtggttcatcaccctttttaacattgtttacacatcactgcctgttttagccatggggatttttgaccaggatgtgagtgaccagaacagcgtggactgtccccagctctacaaaccaggacagctgaatctgctttttaacaagcgtaaatttttcatttgcgtgttgcatggaatctacacctcattagtccttttcttcatcccctatggggccttttacaacgtggctggagaagatgggcaacatattgctgactaccagtcctttgcagttaccatggccacatctttggtcattgtggtcagtgtgcagatagccttggataccagttactggactttcattaatcacgtcttcatctgggggagcattgccatttatttctccattttatttacaatgcacagtaatggcatctttggcatcttcccaaaccagtttccatttgttggtaatgcacgacattccctgacccagaagtgcatctggcttgtaattctcttaacaacagtggcttcagttatgccagtggtggcattcagatttttgaaggtggatttatacccaaccctgagtgatcagatccgccggtggcagaaggctcaaaagaaggcaaggcctccaagtagccgaaggcctcggacccgcaggtcaagctcaagaaggtctggatatgcttttgctcaccaagaaggctatggagagcttatcacatctggaaaaaatatgcgagctaaaaatccacccccaacatcagggctggaaaagacacattataatagcactagctggattgaaaatttatgtaagaaaaccacagacaccgtgagcagctttagccaggataaaacagtgaaactgtgagtcaatatgaatttaaaccacgtagttatcttttcacttcaggtggagctgaaattctgctggctccagagtttgagatttgaggcaagaggtggggcaggcagattgcctcacttaacttaaatctgcggcagacaactgccagtgcccatcaaacaggagtgtgcgctatggaaaaccaggccagagggtcactgtctggtttgtgatttggtggacaaaacactcgctgttacaagtacagattttttttttttttaaatcaacctagataccaattgacctgaactttagaatcttatttatggagaaaaacttgtaaagctgcatattcactgaatggatcctcaggcggataaaagggtgcattttaaaggtatatatccaagctgaaaagcatgcctattgacagataaacatgtatctgtaagatcagcctttcccaaggtatacttttaaaatttaaagcgtgtactgtgttgctttcagactgagttgcatgtcactctttagtcttgatatctacctgtctgttcagccaggacaacaaatggcttccaagcctgaagaatacaaaagtgtgcttgtgtttctcatttttataccagtctagggacaaaggagactgaacatctttgcagcaggataggctggtaatttgatcaaatttattcaaaaagctctcagtctgtgtcatgtaaggacatgcttatgaaatgtgagagaggctcgccactaagtattctaaatacttttcaatggcttttctaacaacctcagtagtaatttgctgagcatcatccagaccattaatagaatcagcaaagcactggaatttcacactttaatgataatattccacatagtctatgggcaaatattttcaacatttccaatttttaaagcttcagaattgaagccaaacaaattaataaataattgttttaattactatttaaaaactcaggtttagattgtttaaaattagttgcttttgatactcagctgtcatgtttataattcaaacatgtagtaaacatatgtaggtaaggttgtttttttggagatgttgcagctcaaatttcagtccacatatgaatcatcagtgtattttccataaagtgattcgggcatatttgtgtgaaaacctcagttctgtcacttcttacctctataaacttggacgataatgtgccttctctgagactcagtttcttcctctgtaaaatgaggacatactacctacctcatgtggttggttgatgattgtctgtcaaagcacaaactctgaaattattaaaaacataattatttcataaacagatgagttaagttccagttaactcaacatcagtataacagagcaattggaagagaatatgaaaaaactggaatctaaatagtcagtgaggaaggctttgataaaatgaaattgccagaaagatataaaactggttagggtcctacagggaaataaaattataaccgtggaggtacatttctctaccagaaagcaaaaataaagcatcatgtcttaatggttttctacaaatcaacttctaattctacagagtccttaatctggtccctattaaattcttggtcagacaaagttacatttcccaagagagtcaggtgacacttgagtgagtttgatggataatgagctaatgtgatatctataggtcacaattttttaaaaccaaaattttcaagtctgggataatctttcctaaatgggatcaaatgaaataatatgtgtaaaagagtcaaatgcagtcctttaccatagtaactgcctatggacgttgtctttcccttacatgcctgcctacacttaaccagatgttggttttcaatgtctaatttgtcattagtttcaccacatttgctcactttttgtaacatttttgcaagatttgaaaactttcagtaaatgttttggcactattggtaaa

SEQ ID NO: 5609 - DNA, 2965 bp, Homo sapiens
ggtgggtcgacccacgcgtccggtctttgtgcagagtgaagctcttgttgctgaacaataaagcatatggtacaagcaataaaacacagggctgggaaatttaagaagattcctctgaaccaggaagaactgtgtcttcggtgatgctgacacatatgataaaatgatcatttattttggatcctaatgaataaagagtgcaaggactaagactacagttatttgaacaggtacatgtgacagcactgcagcgatgagtggaattttaaagaggaagtttgaagaagttgacggctcctcaccctgctcctctgtgagggaatcagatgatgaagtttccagcagtgaaagtgctgacagtggggacagtgtcaatccatccacttctagtcattttaccccttcctccattctcaaaagggagaaacgactgaggacaaagaatgtacattttagttgtgtcaccgtgtactacttcaccaggaggcaaggcttcacaagtgtgcccagtcaagggggaagcaccctggggatgtccagccgccataacagcgtgcgccagtacactcttggcgagtttgcaagggagcaggagaggctccaccgggagatgttgagagaacaccttagggaggaaaagctgaactccttaaaactaaagatgactaagaatggcacagtagaatcagaagaagccagcactcttacactggatgacatttctgatgatgacattgacctggacaacacagaggtagatgagtacttcttcctacaacctttgccaacaaaaaaacgaagagctctgctgcgtgcctctggagtgaaaaagattgacgtggaagaaaagcacgaactccgagccatccgcctctcacgagaggactgtggctgtgactgccgagtgttctgtgatccagacacgtgcacctgcagcctggctggcattaagtgccaggtggatcgtatgtctttcccatgcggctgcactaaagaaggatgtagtaacacagcaggtagaattgaatttaatcctatccgtgttcggactcactttttgcacacaataatgaaacttgaactggagaaaaaccgagagcagcaaatccccacgctgaatggctgccacagtgagataagtgctcacagtagttctatgggccctgtcgctcactccgtagaatattcaatcgcagacagttttgagattgaaactgagccccaggctgcagtgctgcacctgcagtcggctgaagaattagattgccaaggagaggaggaggaagaagaggaggatgggagcagcttttgcagcggagtcacagattctagcacgcaaagcttggcacctagtgagtcagacgaggaggaggaggaagaagaagaggaagaggaggaggaggatgacgatgatgacaaaggagatggcttcgtggaaggtttgggcacccatgccgaagttgtccctcttccttcagttctttgttattctgatggcaccgccgttcacgaaagccatgcaaagaatgcttctttttatgccaactcttcaactctgtattaccaaatagatagccacattccaggaactccaaatcagatctctgagaactattctgaaagagacactgtcaaaaatggtaccctttcgctggtgccttacaccatgaccccggagcaattcgttgactatgcccgacaagcagaagaggcctatggtgcctcccactacccagctgccaacccctctgtaatcgtttgctgctcctcttccgaaaatgatagcggtgtgccctgcaatagtttatatcctgaacacaggtccaatcaccctcaagtggaatttcactcatacttgaaaggcccctcccaagaagggtttgtctctgcattgaatggtgacagtcacatttcagagcatcctgctgaaaattctttgagccttgcagaaaagagcatattgcatgaagagtgcatcaaatcacccgtggttgagacagtccctgtttagtagcttaaattattctaggaccaactcttctcttatttaaggcactgtatttaattggatttcctgggctcatcattggttaaactgaagaccaagaaaacttggacggtggttaatcttccagactgtattttgttttttcctttctagccacatgactgtggcattgcacaaatacagtctctgtagggattttaaaagatttcagactgttttgatagaaaaagctaaattttaaaatgcatatctcacagttgcctacctgtcaaactgtgtgaaacctgccaatctgtgtagatcagagctccaaattttggattatcgggcctgtgcaagattgttaactaaggctgggaaataataagatttagagtcctaattttcaatatatctgaagataatgatgactttttaatgtaaaagtaattattgtaagaaaaagatttaattgttccatgtgtattttatttatggtagtttagaagacatgttttgatgaaaatgaacagccgcatgttcattcaagctgaagatgcatagctagttccacagagcatgcccacatggattgcatctggaatccattcacatttttatgatcatgactgatcagatttgcaaattcttaagggtgaaataggcctatttttgctattttggacaaataaatgattctatatgtgcaggtccttacacacttttctctaaagttaagagttaggacaatcctctggggagagtctagttcactgccctccctcagctgactccagagatggaggtagaaggaattgcctttcttttttaaacagcatcatcttgattcttagcttggacagcacctttaagctctaccccctacatcaaaatgcactttagtgccccttcacggtacctcgtgtggggtggggactgagaactctttgagatgaaaaaatttaaaaaaaaaaaaaa

SEQ ID NO: 5610 - DNA, 526 bp, Homo sapiens
cagctacagcacagatcagcaccatgaagcttctcacgggcctggttttctgctccttggtcctgagtgtcagcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgcctgggccgcagaagtgatcagcaatgccagagagaatatccagagactcacaggccatggtgcggaggactcgctggccgatcaggctgccaataaatggggcaggagtggcagagaccccaatcacttccgacctgctggcctgcctgagaaatactgagcttcctcttcactctgctctcaggagacctggctatgagccctcggggcagggattcaaagttagtgaggtctatgtccagagaagctgagatatggcatataataggcatctaataaatgcttaagaggtgg

SEQ ID NO: 5611 - DNA, 2602 bp, Homo sapiens
gcatgcgcaggctacccagccgcggggggtgcacggagaaaaggggcggggtggtccgggctgctgtgctggcagcagtaggcgagggcgcggctgcggggttcctggtgctgaggacggacgccattggagttcccgagaaggctgagctctcatctccctgggacccgcagcatggctgagggaagcttcagcgtgcaatcggaaagctacagtgttgaagacatggatgagggtagcgacgaagtcggggaggaagagatggttgaaggcaacgactatgaagaattcggtgcgtttggtggctatggcaccctcaccagctttgacatccatatcctcagagccttcggaagcttgggtccaggccttcgcatcttatcgaatgagccctgggaactggaaaaccctgtgctggcccagaccctggtggaggcattgcagctggatccggaaacacttgccaatgagacggccgcccgtgctgccaacgtagcccgcgccgccgcctccaaccgtgcggctcgggccgctgccgccgctgcccgtaccgccttcagtcaggtggtcgctagccaccgggtggccacgccgcaggtctcaggagaggatacccagcccacgacctacgccgccgaggctcaggggcccacccctgagccaccccttgcttctccgcagacctcccagatgttagtcaccagtaagatggctgcccccgaggctccggcaacctccgcacagtcccagacaggctccccggcccaggaggctgctactgagggccctagtagcgcctgtgctttctctcaggctccgtgtgccagggaggtggacgccaaccggcccagcacagccttcctgggccagaatgatgtcttcgatttcactcagccggcaggtgtcagtggcatggccttcccgcgccccaagagacctgccccagcccaagaggctgccacagagggccccagtgctgcctctggtgtgccccagacgggacctggcagggaggtggcagccacccggcccaagaccaccaagtcggggaaggcgctggccaagactcggtgggtggagcctcagaatgttgtggcagcagctgctgccaaggccaagatggccacgagcatccctgagccggagggtgcagctgctgccactgctcagcacagtgctgagccctgggccaggatgggaggcaagaggaccaagaagtccaagcacctggatgatgagtatgagagcagcgaggaggagagagagactcccgcggtcccacccacctggagagcatcacagccctcattgacggtgcgggctcagttggcccctcggcccccgatggccccgaggtcccagataccctcaaggcacgtactgtgcctgcccccccgcaacgtgacccttctgcaggagagggcaaataagttggtgaaatacctgatgattaaggactacaagaagatccccatcaagcgcgcagacatgctgaaggatgtcatcagagaatatgatgaacatttccctgagatcattgaacgagcaacgtacaccctggaaaagaagtttgggatccacctgaaggagatcgacaaggaagaacacctgtatattcttgtctgcacacgggactcctcagctcgcctccttggaaaaaccaaggacactcccaggctgagtctcctcttggtgattctgggcgtcatcttcatgaatggcaaccgtgccagcgaggctgtcctctgggaggcactacgcaagatgggactgcgccctggggtgaggcacccattcctcggcgatctgaggaagctcatcacagatgactttgtgaagcagaagtacctggaatacaagaagatccccaacagcaacccacctgagtatgaattcctctggggcctgcgagcccgccatgagaccagcaagatgagggtcctgagattcatcgcccagaatcagaaccgagacccccgggaatggaaggctcatttcttggaggctgtggatgatgctttcaagacaatggatgtggatatggccgaggaacatgccagggcccagatgagggcccagatgaatatcggggatgaagcgctgattggacggtggagctgggatgacatacaagtcgagctcctgacctgggatgaggacggagattttggcgatgcctgggccaggatcccctttgctttctgggccagataccatcagtacattctgaatagcaaccgtgccaacaggagggccacgtggagagctggcgtcagcagtggcaccaatggaggggccagcaccagcgtcctagatggccccagcaccagctccaccatccggaccagaaatgctgccagagctggcgccagcttcttctcctggatccagcaccgttgacgaactgcagcgatcttactggccaagccagagcgcctcctctcagattccttctcgacacagcaccctaggcggcttcttcctgtcagtcggaggtggcatgcaagatgaagctctctttgctcttcctgctttcattttgtgcttttccttgtgttttcatgttttgggtatcagtgttacattaaagttgcaaaattaa

SEQ ID NO: 5612 - DNA, 1941 bp, Homo sapiens
gagagggcgaaggtaggctggcagatacgttcgtcagcttgctcctttctgcccgtggacgccgccgaagaagcatcgttaaagtctctcttcaccctgccgtcatgtctaagtcagagtctcctaaagagcccgaacagctgaggaagctcttcattggagggttgagctttgaaacaactgatgagagcctgaggagccattttgagcaatggggaacgctcacggactgtgtggtaatgagagatccaaacaccaagcgctccaggggctttgggtttgtcacatatgccactgtggaggaggtggatgcagctatgaatgcaaggccacacaaggtggatggaagagttgtggaaccaaagagagctgtctccagagaagattctcaaagaccaggtgcccacttaactgtgaaaaagatatttgttggtggcattaaagaagacactgaagaacatcacctaagagattattttgaacagtatggaaaaattgaagtgattgaaatcatgactgaccgaggcagtggcaagaaaaggggctttgcctttgtaacctttgacgaccatgactccgtggataagattgtcattcagaaataccatactgtgaatggccacaactgtgaagttagaaaagccctgtcaaagcaagagatggctagtgcttcatccagccaaagaggtcgaagtggttctggaaactttggtggtggtcgtggaggtggtttcggtgggaatgacaacttcggtcgtggaggaaacttcagtggtcgtggtggctttggtggcagccgtggtggtggtggatatggtggcagtggggatggctataatggatttggtaatgatggtggttatggaggaggcggccctggttactctggaggaagcagaggctatggaagtggtggacagggttatggaaaccagggcagtggctatggcgggagtggcagctatgacagctataacaacggaggcggaggcggctttggcggtggtagtggaagcaattttggaggtggtggaagctacaatgattttgggaattacaacaatcagtcttcaaattttggacccatgaagggaggaaattttggaggcagaagctctggcccctatggcggtggaggccaatactttgcaaaaccacgaaaccaaggtggctatggcggttccagcagcagcagtagctatggcagtggcagaagattttaattaggaaacaaagcttagcaggagaggagagccagagaagtgacagggaagctacaggttacaacagatttgtgaactcagccaagcacagtggtggcagggcctagctgctacaaagaagacatgttttagacaaatactcatgtgtatgggcaaaaaactcgaggactgtatttgtgactaattgtataacaggttattttagtttctgttctgtggaaagtgtaaagcattccaacaaagggttttaatgtagatttttttttttgcaccccatgctgttgattgctaaatgtaacagtctgatcgtgacgctgaataaatgtcttttttttaatgtgctgtgtaaagttagtctactcttaagccatcttggtaaatttccccaacagtgtgaagttagaattccttcagggtgatgccaggttctatttggaatttatatacaacctgcttgggtggagaagccattgtcttcggaaaccttggtgtagttgaactgatagttactgttgtgacctgaagttcaccattaaaagggattacccaagcaaaatcatggaatggttataaaagtgattgttggcacatcctatgcaatatatctaaattgaataatggtaccagataaaattatagatgggaatgaagcttgtgtatccattatcatgtgtaatcaataaacgatttaattctcttgaaaaaaaaaaaaaaaaaa

SEQ ID NO: 5613 - DNA, 2219 bp, Homo sapiens
gtcagggccagggtgagcgcccgactccgagctgtccccgctcccggcgcggcgctccgctctcagccacctcacggctgccaggagtgcgcgggagtttgccccggagcgcggggaagtttcctccgaagctgcgctcctggaacagcagcacctgcaagcgcccggcagcggcccgcgaggttactttatggaattgggctcttagagaacaagaaaagactgaagttttacgggaaaacaaatcatgtggtcttcagattctgaaataaggagaaatgcagccatctgaaatggtcatgaaccccaaacaagtcttcctctctgtgctgatatttggagtagctgggctactcctcttcatgtatttgcaagtctggattgaagaacaacatacagggagagtggagaagagaagagaacaaaaagtaacttcaggatggggaccagtgaagtacttgcggcctgtacccagaatcatgagtacagaaaaaatccaggaacatatcaccaaccagaaccccaagtttcacatgcctgaggatgtacgagaaaaaaaggaaaatcttctactcaattctgagagatctactaggctcttaacaaagaccagtcattcacaaggaggggatcaagctttaagtaagtccacagggtcaccaacagagaagttgattgaaaaacgtcaaggagctaagactgtttttaacaagttcagcaacatgaattggccagtggacattcaccctttaaacaaaagtttagtcaaagataataaatggaagaaaactgaggagacccaagagaaacgaaggtctttccttcaggagttttgcaagaaatacggtggggtgagtcatcatcagtcacatctttttcatacagtatccagaatctatgtagaagataaacacaaaatcttatattgtgaggtacctaaggctggctgttccaattggaaaagaattctgatggtactaaatggattggcttcctctgcatacaacatctcccacaatgctgtccactacgggaagcatttgaagaagctagatagctttgacctaaaagggatatatacccgcttaaatacttacaccaaagctgtgtttgttcgtgatcccatggaaagattagtatcagcctttagggacaaatttgaacaccccaatagttattaccatccagtattcggaaaggcaattatcaagaaatatcgaccaaatgcctgtgaagaagcattaattaatggatctggagtcaagttcaaagagtttatccactacttgctggattcccaccgtccagtaggaatggacattcactgggaaaaggtcagcaaactctgctatccgtgtttgatcaactatgattttgtagggaaatttgagactttggaagaagatgccaattactttttacagatgatcggtgctccaaaggagctgaaatttcccaactttaaggataggcactcttccgatgaaagaaccaatgctcaagtcgtgagacagtatttaaaggatctgactagaactgagagacaattaatctatgacttttattacttggactatttaatgtttaattatacaactccatttttgtagtttgcattcattttctaaaaccctgtatatacttaatgatgataagttcaaatcagctgtaatttttctataattctctgtatgacagaaatttaaccaagtgcagttgtcttgatttaatgtagatttttaccaaatagtatgacaccaattggcacaaagttataggaaaatcacctacaggagatgtaaacaacttgagttgctctaaaatgtttggaaaagagctgcttttgcattatgaattatattgttgaagcaataacctagccagctgttgcattagctaaagcagcctcttgcaatggtaggaaaaaaggatctcaaatagcatgagtgtatgtctatatcctgaaatttattgtctaaaatgcatgaatatatttttagcagtctgtggcatattaatcaaactgttgaattgttttcttacaccctggaaatctttctatcaactataatgataaatccattttgaagtgatattttggacttaggcattttactttagattggaaggcattatgtgatttacaatatgagaatatagcagaaaaaccagatgaggctgtggctttttatattcaacagccaataaaaaatgcacaa

SEQ ID NO: 5614 - DNA, 4675 bp, Homo sapiens
ccgggcggcgctgggcttttatctgcggacccgccgggagggagccagatcccagcgatcttccccgacggcagcgctttacccagaggctgccggcggctcgtagctgggttcagctctgcgtccacgccagcccggagcccggggggcaaggggtctgtcccgggcgcagcgagaggatggtcatccgcgtgttcatcgcctcttcctcgggcttcgtggcgataaagaagaagcagcaagatgtggttagatttctggaagccaacaagatagagtttgaggaggtggatatcacaatgtcagaagaacagaggcaatggatgtacaaaaacgtccccccggaaaagaaacccactcagggcaaccccctgccacctcagatatttaatggcgaccgatactgtggagattatgacagtttttttgaatccaaggaaagcaacacagtcttttcatttttaggcctgaaaccacggttggcatcaaaggcagaaccttagagaagaagagtggaagatgacggagatgcattttgaagcacccctggtactcagcacacacatgcttacctaatgcatcactgtgacaaaagccacacgcattatcagtaactttgcttgccacggaaaaggtgtttttgaaagatgtggctataatgagaattgcatgattgctttaaaccaaatcaggtggtggattttttttttcttattctatttgcctgcagttgcctcactcacctggaaataccgtcacctgttacaggtgtactttcttaatgactgaaagataagtgggtagcaccgtcagagagaaaatgttggatctgccctaggttatagtagatgccggaattgcgtaaacccacttctctttaagctgcctggattgcacctttgaaatatgtctgccaagttgttagaatctttgaatcagaaggaaaaaaagcagcgctggttgacaaagggtgttgaagatttttgctgcagaatcagttacaaacatcacagttcccatgctttgtaataacacctggtgaaaaagttagatattctagacttgttttagtaatggaaactcttacctccacatattatcttacagatgtttccagaaatccctgttgtaacatcaagtgatcagaactaagttactgggatgacaataattgctatttgaaatatatgcttctttatttcttgcaaggggcaagtttcacccaaatgcctgagactgcttgaaagatatattttaagtggtgcactaattagtgaatatataggaaaattatctgacgagtatctgaaggcattttcagctctagcaatttatttataatatataagttcatatattttttaatccagctcccctaacagacagctgctgcttctattttgtgaagggactatattttttgagaaaggaaaatctcagttagatatattttgtgaacccttgattagacatattaaaatataccaatgttgtagtaaaatttaatttttccttttgttacttttcatttgcctctaattttgcttgctcatatttctggccaatgtacagcctcatatttttcagagtaatacagatacttgttctcattccgtatatgagcacaagtaaggtttcagagcaacacacatgagaaagagagtaacccggaattgtacttgtcaagcaaaatctatactcctattggagtggatgctgatgaacatcgaacatatctacttcattagagcagaggctatttttctgcattcttgtccctataacagggatgcttaattttttttttaacttagagttttaaattgccaaacatgggaacagccttgaataggataaattttcagagggctgcctaaaatattttatttctagcatcctgattctggacttttcattataattctgagcaggaaatttataagaaattgaaagagcagaagaattacagccctgtcacatgtgcccagcactccgccccatgccttgctaaatgtagactaaagaacttgttgaatgctaaggctgaaatcccaacctgagatttgtagtccaggattacaaccagaaggaaagtatgacagatttctacttaactagaatggacacatgatccacaattttctcttcaggggaagctgttgtcaaattatggatattactggttagttgtcattaagtaagatccaggtcaaattccatttgacaaatcccagggactatccaggaatttttttttaactggatattgtgtttgagtatgtgagtcttctgataaaactcagaatttctttttaagcagttgtaaaaattgtcatgttgtaattcattactcagctaacatttagtctactcttgctagtgagtgccaagaaccaacttggtaaggttgaggctttgcaagttaactgctggggttataggatcaataccatacttgctagacaaagctacccagatttgtcttatattataatttttgagttaaccgtagtatacctattatgattatagtaaacagactagtgggtagtaatgctaaattaccatcacagttatgtgccatctccccaccccatttttttttttttttttttgatcagcaaagaaatacaggagaccagtctcgagtggtgctgtacttgttatgagtggggcagcagcacagtgtgtggcatttacatggtacccaggctccacagagtaccaagatgttgccctctgggaccacacttagctcagagaatatggggtccttacttgtattctgttatcagctgattttgaaacatataataatgattttcttgttcccttctttaactagctgcctttagattttgataatcacagtcttaaaatactaggaaagaagtggatgggaattgtaggcatagatttcatatcaagggcatttcaagacagaatttttatttcctgtagtaggcttgctggagcaaaggaaatgtgctgctaaaaatcaacttatgccattttaaaattagataaaatatggagtgccatcctgctaggtgagtacagaccagaagaaaatttagttgggaaaatacttgtttttccaaattccggtgttttattacaatcaaagaagaggaaagcaaggtattttttcacctcagattctaatatattctagatttgtttctgttttatagatttaattcaatacctccacatagatgtttttatattacatgaatttaataataaactaaacttttttttgtctcccgttattgaaaagtaccaaagcttctttctgttgtgtttgattttactataggggttttgctttttctagagatacttttcatttaacagcttttgttaagtgtcaggctgcactttgctccatataattattgttttcagatttcaacttgtatgtgtttgtctcttaaagcattggtgaaatcacatattttatattcagcataaaggagaataaattccagaaaacacatattctgaaaatggagtgtttgttccctgccatttttcacacctctcttaattttagttctgtttagttgagaggctgtgattttactcttgcctgtgaacctcatgcatgaaagcagcacattaaattgtaaaaatacaaacagatcgtgtgatcattcaaggagccagacatgaggtcctgcacgagggtgttgggaggacaccacagattcatctcagacagtgatcaggactgaggatggagttaaatcactcagcccctgggtggggtggggtggttcaaatggatgactgatctcctgagtacactgaagccacaggctggtggccatgttctctgaattgggtgcagaagacaagggcagagtggctgcggcccctattacctttgtagcagccacatcagaaagcagaagaaaacagtatttctgaaggcattgtttgaggttgatctcagcactgaacgatttcaagccctacgcaccagaacagaaggagggtggaggaagtgatcagagggaacgagctgtaggtttgcagaaatgtgtgaaaccaaaatgatcactgcctacttgtgattcaaatcttcagagttttcctagttcttctagaaatacatgtcaggtttgtttgttcatcctttctgtcagcatggatcaagcccctaaaatgtggtaagtgttgtcagagcagggcaatatctctactctcaagtatgaggggaatagaaacaaagcagcagttttagccagggttcaatgatagagtggaggtaaattaagagcctccaggctgtgattcaccatttgagacattatacataatttgtttttgttataagccatttgaatttttaaaaaatttcatacatgcaatggaatatagatatgtatatacacatataatatatatgctaaagtataaagagtaataataatgacaataaacaaacccctgtgtgcctaccacccaccttattgcctttcctttgaggtaccgtgtgcggtttcctgaacctatctctatccctgtctgatagagggaacccctgtactgaactttgtgttgaccatagccttcttgtctttcatcactttatctccatgtatgtatccttaaagaataataaatggaattaaactcaaaaaaaaaaaaaaaaaaaaaaaaaaaa

SEQ ID NO: 5615 - DNA, 2101 bp, Homo sapiens
acgaacaggccaataaggagggagcagtgcggggtttaaatctgaggctaggctggctcttctcggcgtgctgcggcggaacggctgttggtttctgctgggtgtaggtccttggctggtcgggcctccggtgttctgcttctccccgctgagctgctgcctggtgaagaggaagccatggcgctccgagtcaccaggaactcgaaaattaatgctgaaaataaggcgaagatcaacatggcaggcgcaaagcgcgttcctacggcccctgctgcaacctccaagcccggactgaggccaagaacagctcttggggacattggtaacaaagtcagtgaacaactgcaggccaaaatgcctatgaagaaggaagcaaaaccttcagctactggaaaagtcattgataaaaaactaccaaaacctcttgaaaaggtacctatgctggtgccagtgccagtgtctgagccagtgccagagccagaacctgagccagaacctgagcctgttaaagaagaaaaactttcgcctgagcctattttggttgatactgcctctccaagcccaatggaaacatctggatgtgcccctgcagaagaagacctgtgtcaggctttctctgatgtaattcttgcagtaaatgatgtggatgcagaagatggagctgatccaaacctttgtagtgaatatgtgaaagatatttatgcttatctgagacaacttgaggaagagcaagcagtcagaccaaaatacctactgggtcgggaagtcactggaaacatgagagccatcctaattgactggctagtacaggttcaaatgaaattcaggttgttgcaggagaccatgtacatgactgtctccattattgatcggttcatgcagaataattgtgtgcccaagaagatgctgcagctggttggtgtcactgccatgtttattgcaagcaaatatgaagaaatgtaccctccagaaattggtgactttgcttttgtgactgacaacacttatactaagcaccaaatcagacagatggaaatgaagattctaagagctttaaactttggtctgggtcggcctctacctttgcacttccttcggagagcatctaagattggagaggttgatgtcgagcaacatactttggccaaatacctgatggaactaactatgttggactatgacatggtgcactttcctccttctcaaattgcagcaggagctttttgcttagcactgaaaattctggataatggtgaatggacaccaactctacaacattacctgtcatatactgaagaatctcttcttccagttatgcagcacctggctaagaatgtagtcatggtaaatcaaggacttacaaagcacatgactgtcaagaacaagtatgccacatcgaagcatgctaagatcagcactctaccacagctgaattctgcactagttcaagatttagccaaggctgtggcaaaggtgtaacttgtaaacttgagttggagtactatatttacaaataaaattggcaccatgtgccatctgtacatattactgttgcatttacttttaataaagcttgtggccccttttacttttttatagcttaactaatttgaatgtggttacttcctactgtagggtagcggaaaagttgtcttaaaaggtatggtggggatatttttaaaaactccttttggtttacctggggatccaattgatgtatatgtttatatactgggttcttgttttatatacctggcttttactttattaatatgagttactgaaggtgatggaggtatttgaaaattttacttccataggacatactgcatgtaagccaagtcatggagaatctgctgcatagctctattttaaagtaaaagtctaccaccgaatccctagtccccctgttttctgtttcttcttgtgattgctgccataattctaagttatttacttttaccactatttaagttatcaactttagctagtatcttcaaactttcactttgaaaaatgagaattttatattctaagccagttttcattttggttttgtgttttggttaataaaacaatactcaaatacaaaaaaaaaaaa

SEQ ID NO: 5616 - DNA, 772 bp, Homo sapiens
ggataacccgcggccgcgcctgcccgctcgcacccctctcccgcgcccggttctccctcgcagcacctcgaagtgcgcccctcgccctcctgctcgcgccccgccgccatggctgcctcccccgcgcggcctgctgtcctggccctgaccgggctggcgctgctcctgctcctgtgctggggcccaggtggcataagtggaaataaactcaagctgatgcttcaaaaacgagaagcacctgttccaactaagactaaagtggccgttgatgagaataaagccaaagaattccttggcagcctgaagcgccagaagcggcagctgtgggaccggactcggcccgaggtgcagcagtggtaccagcagtttctctacatgggctttgacgaagcgaaatttgaagatgacatcacctattggcttaacagagatcgaaatggacatgaatactatggcgattactaccaacgtcactatgatgaagactctgcaattggtccccggagcccctacggctttaggcatggagccagcgtcaactacgatgactactaaccatgacttgccacacgctgtacaagaagcaaatagcgattctcttcatgtatctcctaatgccttacactacttggtttctgatttgctctatttcagcagatctttctacctactttggtgatcaaaaaagaagagttaaaacaacacatgtaaatgccttttgatatttcatgggaatgtttaaaaatagaaataaagcattttgttaaaacga

SEQ ID NO: 5617 - DNA, 5428 bp, Homo sapiens
ctccctctcctatcggagcacaatgaaagcctgtgtatcgccgtgactccgggcgggagccagtgtcagcaaagcggctaacaacagacgagaaagagaaaggaaaatacaagctactttttttttccatctataaagcggagcaaatacaggagatagaaccagattgcttattgcgagtccagaccctcagatccactggccggggatggaatgtacaaaagtggacagaaaagtggctggacatgactcggtgcaatttgctggaagtttgtaagtttgaccatcgtttgtaaattactctcggaagagtttgtctctcttgatactgtattagaatagagccgggggtgaggaatagaaacgtaagcgggaaagaaaaaaatgtgttgaaggatctctctcagtggctagcgacttaagattgcttttcatttaaggctaggaaaccttagagggagtgaggattttaccggtgattggattagctgaagaaaaaagcatggtccaaaagtccaattactgacattgttaacagttgaaaagctgtctccctcttttgggagaagacaacatcctacagtaccccaaagaggagaaaacaccggagcgaaaggaaagggaggaaaaattaaaagccaaaagacagtctcccttgatttttgcacattttgaacagtgacttaaacatcttctgaaacagcactgttttgttttgttttggttttttatttaacctgaggaaaagtcaaggctgctggttacatagacatggtagaaatgtgtttctctgcagaaacatccccataaagaattgtcggaaacaactaggtgagggggagtcctctctattaatacctctctcaataccttttgctgtgtgtttctgtctcttgctggacaatccctgaattcttgatctaacccccagatcgtgtgtttacaaagtacctagtggctcttgtcagcttggtggaggaaaaaaaatccaccaactctgtccaacttctccagagctgtcaaatgcaattagagtaagttaatcagggtttgtttccaacttatcctccccccagttggtttctattctttctccccaccctctttttactaactcccctcccccacaacttctccacggctcccccacaacctctgaagacctctattcatgtggccctgaacactgagctcacattgtcaaaaacagacttgcctgcaatagccagcagtagcctctttccacctcaccatcccagaggcagcaatcattgtgtccggtaagatgggggacacagcgcccccgcaggcccccgcaggagggctagggggggcctctggggcggggctccttggagggggctcagtcaccccgagagtgcacagtgctatcgtggagcgcctccgggctcggatcgctgtctgccgccaacaccacctgagctgtgaaggacgatatgaacgaggtagggccgagagctcagaccgggaaagagaaagcaccttgcagctcctgagccttgtacagcatggccagggggcaaggaaagctggcaaacacaccaaggccaccgccactgctgccaccactacagcccctccaccgccccctgctgcccctcctgcggcctcccaagcagcagcaacagcagccccaccgcccccaccagactatcaccatcaccaccagcagcacctgctgaacagtagcaataatggtggcagtggtgggataaacggagagcagcagccgcccgcttcaaccccaggggaccagaggaactcagccctgattgcgctccagggttccttgaaaagaaaacaggtagttaacctatctcctgccaacagcaagcgacccaatggctttgtggacaactcatttcttgatatcaaaagaattcgtgttggggagaatctctctgcaggacaaggtggcctccaaataaacaatggacaaagtcagattatgtcagggaccttgcctatgagccaagcacccctgcgaaagactaacactctgccatcccatacacattctcctggcaatggcctgtttaacatgggcttaaaggaggtaaagaaggagccaggagagactctgtcttgcagtaagcacatggatggccaaatgacccaagagaatatttttcctaataggtacggagacgaccctggagaacaactgatggatcctgagctgcaggaactgttcaatgaactgaccaacatatctgtgcctcccatgagtgaccttgaactggagaacatgatcaatgccaccataaagcaggatgacccatttaacattgacttgggtcagcaaagccagaggagcacacctaggccctccttacccatggagaaaatagtgatcaaaagtgaatactcaccgggcttgactcagggcccctcaggctctcctcagctgaggcccccatcagctggccccgcattctccatggccaactctgccctctccacttcgtctccaatcccttcagtccctcagagccaggctcagcctcagacaggctccggagcaagccgggccttgccaagctggcaggaagtatcccatgcccagcagctcaaacagatagctgctaatcgtcagcagcatgcccggatgcagcagcaccagcagcagcaccagcctaccaactggtcagccttgccctcttctgctggaccatcaccaggtccatttgggcaggagaaaatccccagcccttcttttggtcagcagacattcagcccacagagctcccccatgcctggggtagctggcggcagcggccagtcgaaagtaatggctaactacatgtacaaggccggcccctcagcccagggtgggcacctagatgtcctcatgcagcaaaagcctcaggatctcagtcgaagttttattaacaacccgcacccagccatggagccccgtcagggcaacaccaagcctttgtttcattttaactcagatcaagcgaaccagcagatgccttctgttttgccttcccagaacaagccttctctcctacactacacccaacagcaacagcagcaacagcagcagcagcagcagcagcagcagcagcagcagcagcaacagcagcagcagcagcaacagcaacagcaacagcaacagcagagttcaatttcagctcaacaacagcaacagcagcagagctcaatttcagcccaacagcagcagcagcagcaacaacagcagcagcagcagcaacaacaacagcaacaacagcagcagcagcagcagcaacaaccatcttctcagcctgcccaatctctaccaagccagcctttgctaaggtcacctttgccacttcagcaaaagctcctacttcagcaaatgcagaatcagcccattgcaggaatgggataccaagtctcccaacaacagagacaggatcaacactctgtggtaggccagaacacaggccccagtccaagtcctaacccctgctcaaatccaaacactggaagtggttacatgaactcccagcaatcactgttgaatcagcaattgatgggaaagaagcagactctacagaggcagatcatggagcagaaacagcaacttcttctccagcagcagatgctggctgacgcggagaaaattgctccacaagatcagataaaccgacatttgtcaaggccacctccagattataaagaccaaagaagaaatgtgggcaatatgcaaccaactgctcagtattctggtggctcatccacaataagcttaaactctaaccaggctttggcaaacccagtttcaacacacaccattttaactcccaattccagcctcctgtctacttctcacgggacaagaatgccatcattatctacagcagttcagaatatggggatgtatggaaatctgccttgtaatcaacctaacacatacagtgtcacttcaggaatgaatcaattgacccaacagagaaacccaaagcaattgttagcaaatcaaaacaaccctatgatgccacggccacctaccttagggccaagtaataataacaatgtagccacttttggagctggatctgttggtaattcacaacaattgagaccaaatttaacccatagtatggcaagcatgccaccacagagaacatcaaacgtaatgatcacatccaacacaactgcaccaaactgggcctctcaagaaggaacaagcaaacagcaagaagccctgacgtctgcaggagtccgcttccccacaggtacacctgcagcctataccccaaatcagtcactgcaacaggcagtaggtagccagcaattttcccagagggcagtggctcctcctaaccagttaacaccagcagtgcaaatgagacccatgaaccaaatgagccaaacactaaatgggcaaaccatgggtcccctcaggggtctgaatctcagacccaatcagctaagcacacagattttgcctaatttgaatcagtcaggaacagggttgaatcagtcgaggacgggcatcaaccagccaccatccctgacgcccagcaattttccttcacccaaccaaagttccagggcttttcaaggaactgaccacagcagtgacttagcttttgacttcctcagccaacaaaatgataacatgggccctgccctaaacagtgatgctgatttcattgattctttattgaagacagagcctggtaatgatgactggatgaaagacatcaatcttgatgaaatcttggggaacaattcctaaagaagaaagggaagacaatttacaaactccaagcactaaaaggcagtatattacagaaactctgtagaggctgaactgttgatgttcaggtggactacatgaagataacatgcttaaaaatggaaagcagaaagtaactgcagtgatgaacattttggtccaaattcttgttttaaatcttacacctgaaagtaaaatattgggatcacttttccctgtctaaactccaggatacagtatccaatttatccaaacagaactgtggtgtcaatgtgtaattaattgtgtaaaatagccttcccaagtttctttttccctggaaaataaaaaaggtaatagaacttgtagtttatttaaaccccatgtcatgaggaggtactagttccaagcaacaaactccttaatttgctctaatagataggtatggtttaatctttccattgtgtcttttcatttaattttcctgaagcttgcaggatagattgaaatgttataggtttgtttggagtaaccaaacagtatgcaaattaagaaaaagccagagaacctagaaaacatccagtggattacagaatttcttccccatattcactcctcacttttacaattttcccacaatcctctacttcagtgggatgctgtgtctagtgattaaacaaaaatatagagctg

SEQ ID NO: 5618 - DNA, 3768 bp, Homo sapiens
gagaggctggcggcagtggtggctctcccggctgggttgtcagtcagtgagaggagggggaagatggctcaccgggacccgttctgctaggaagaaggggagcaggtggtgctgctactcgggaggaagcagagcagcctccgtcgctgtcgctgagagcctcacgagtcgaggtcctgcaggtggagctccggcagccgccctggttgaaggtttagaacagatgtggaaaaatgtttacttcagagaaaggggttgtggaggaatggttgtcagagtttaagacattaccagaaacatctttaccaaattatgccacaaatttgaaagacaagagttctttagtttcatctctctataaagttatccaggagccacaaagtgagttgctagaacctgtctgtcaccagctctttgaattctatcgcagtggagaggagcagttgcttcaatttacgctgcaatttctcccagaactaatttggtgctaccttgcagtctcagccagcagaaatgtgcatagcagtggatgcattgaagctcttcttctaggggtttacaatttggaaatagttgacaaacagggacataccaaagtattgagttttacgattccatctttatccaaaccatctgtataccatgaaccttccagcattgggtccatggctctgactgagagtgcactatcccagcatggtttgtcaaaagtggtatacagtggacctcatcctcaaagggagatgctgacagcacagaatcggtttgaagtgttgacattccttttgttgtgttacaatgctgccttaacttacatgcccagtgtttctcttcagtcactgtgtcaaatttgttcaagaatctgtgtttgtggatatcctcgacaacatgtaagaaaatataaaggtataagtagcaggataccagtttcttcaggattcatggtgcaaatgttaacagggatttattttgccttttataatggagaatgggatctagctcaaaaagcactggatgatattatatacagagcccagctagaattatatccagagccattgctggttgctaatgcaataaaggcttcattgcctcatggtcccatgaaatctaataaggaaggtacaaggtgtattcaagttgaaatcacaccaacttcctctcgaatatcaagaaatgcagtaaccagcatgtcaataaggggtcataggtggaaaagacatggaaatacagaattaacaggtcaagaagaactgatggagatatctgaagttgacgagggattttattccagggctgcgtctagtaccagccagtcgggtttatcaaacagtagtcacaattgtagtaacaagccaagtataggaaagaaccacagacggtcaggaggaagcaaaactggaggaaaagaaaaagaaactacaggggaatcttgcaaagatcactttgctcgaaaacaaactcagagagcccaaagtgagaatcttgagcttctctctttgaagagacttactttaacaaccagccaatccctacctaagcctagtagccatggtttggctaagaccgcagcgactgtatttagtaaatcctttgaacaagtcagtggtgtcacagtcccacataacccgtcatctgctgttggttgtggggctgggacagatgccaataggttttccgcttgtagtctccaagaagaaaagcttatttacgtttcagaaagaactgaacttccaatgaagcatcaatcaggtcagcagagacctcctagtattagcattactctgtccacagattaattagtaacatatttttctcccataacctagtgaacctggaaatacaactttgcttctttatgaaagtaccctgggtctttcatccgtattcctgacaggagccctgatgtcttaaattctgaaggctcccctgactttatgaagggaagattgtctaggttgcagtaagttgaaatatggttttgttatttcttgattaagattttttccccttggtttgagtcttttttttccctcctcttatttgttattgttgccctaagattgtcagtgacaataaattttgacaggttgtctaatcaagttggttatgtctcatgtgaggttgtaaggtggtttttcttgttttggtttggtttggttttttaatagctcctattttgatggctgtgtgtttggccttcagagtcaaagggagtctgcatgtatgggaactgttttatagagaatggggcagaggcacaactccaggaattctctagctcctggtcaggaagccaatctgaaaacaggcatgtggaaacacaaaaatgatgtgtatgaaaagcacctgatgaaaatatttgtaagcagatcatctttatgattagaacaatttgctcaaagccctggaaaatgcctggtaacccagtgcctagaatattatatgattccaggggatggctagaggcatttctgttgttatctctgaaacatttttatatcaaaaatcagattgctggtaggtgtgttgttttgaagtgttttatctggatttagcatgtgaagatccctttcaattattaaggtataataggctgtaaagctgatttaccctactgctggactttggaaatcctagttagtttggactcctataattcagagcatacgtcattggaagacttcctggaaatcagtgtaaatcttgcaacatagctctcaagataccactgtataatatgtaattgtttgtctgcaaatgcatttttcatctataaaatgtcatgaaagaaaataaaggtagtgaaatatggacaaaggacatttatatattaactaaagttgtttatgtttgtgttcttaaatttaaaacacgaagaaaaagaaatgtctttcttgttagtgaacaggcctgttttaaatatcttagtatgatatcaaaagaataatcaatttagttacctcccaactaaaaagtaaaaatgaaaaagacgacatggcagaagttgaaacaaacttgtatgtatctgtatgtgacctctagatggaaataaaagtttgatgtttgctagccgtggtccttttggctatggttgcggttcccctgtaaagcaaatgtacttaagtcatcattcagagtgagagagagaaagcacggctgaggctgagtcagttgaccgttgaggaagacctaaggagctgtccagttcttggctctttttcactgtgactgcacagcggtttccttcttcatagtcccttgctgtagtcaccaagagagcatgctagtgttttcctcttgttcctgcttatgcagagctcagatatatgaaaaatttgtatgctttgaaggctgccaaagcatttatactctggacatagttttaactgcaactgctttggctaccagtttaaaccgagttcttcaaaaagcatgaactcgttttcattcattagccctgtttacaatgtggattttgacataaatgaatttgattttcttttagctccagtaacagaatggaataagatctattgccataaattgtagttaagaactgtaaggcaatcgggcagtgaaacttgatattgtattaacttaataggaaccctgtgtacaatttaaaatatttgtaaaatatcactgtgaatttacagatgtctttttgtcattctttaacaatgaatttcccctgtgcatagttattaatagtattggtattattaaaaactaatttggcattttaaaaaaaaaaaaaaaaaaaaa

SEQ ID NO: 5619 - DNA, 2204 bp, Homo sapiens
gtcgggcggagcaggcggctgcttgacagctgagagccgagcgggcggcgcgggcaggtccacgggaagcctacacgcccaaggtcatgccctgaccacagctgcccttcaggaggctggcacggagccacctggggccattgggctgtttgtcaagggtggggcagcagcaacttgccactcttcctccatgagcccagccagagcctccactgggcacttagcacaagaaaaaccctgcaggagccggatccagagcgctgggattcagcaggagtgccaggagaattcaacacaggtgtgctgcctcctctcctgccaggtgtgtggctgcacaggagtcttgctgatggtggaattcaagtcaccagtggccaaagtaccctccaggtgtgaagagttgcaggtcctccgaggagccgggagctgcaaggttctgaaaaagacttcaagaaactgactaatcgcgatggctgcccctgacgggagggtagtctccagaccccagagacttggtcaggggtctggccaggggccaaaggggagtggagcctgcctgcatcccctggacagcctggagcagaaggagactcaggagcaaacgtcgggccagctagtcatgctgaggaaggcacaggagttctttcagacctgtgatgctgaaggcaagggcttcatcgccaggaaggatatgcagaggctgcataaggagctaccgctcagcctggaggaactggaggatgtgtttgatgccctggatgctgatggcaatggctatctgaccccacaggagttcactactggatttagtcacttcttcttcagccagaataacccaagtcaggaagatgcaggtgaacaggtggcccagcgccatgaagagaaggtgtatctgtccagaggggatgaggatctgggcgacatgggcgaagatgaggaagcccagttccggatgctgatggacagacttggagcccaaaaggtgttggaagatgaaagtgatgtcaagcagctctggttgcagctgaagaaggaggaacctcatttactgtccaactttgaagacttcctgaccagaatcatctcccagctccaagaagcccatgaggagaagaatgaactggagtgtgccctaaaaaggaaaattgctgcttatgatgaagaaatccagcatctctatgaggagatggaacaacaaatcaaaagtgagaaggagcagtttctcctgaaggacacagagaggtttcaagcccgcagtcaagagctggagcagaaactgttatgtaaggagcaggagctggagcagctcacccagaagcagaaaaggctggaaggtcagtgcacagccctgcatcatgacaagcatgagaccaaggctgagaataccaagctgaaactcactaaccaggagctggcccgggagctggagcggacttcctgggagctccaggatgctcagcagcagttggaaagcctccagcaagaggcctgcaaactccaccaagagaaggagatggaagtgtaccgtgtgacggagagtctacagcgtgagaaggccgggctcctcaagcagctggatttcctaaggtgcgtcggtgggcactggcctgtgctgagagcacctcccagaagcctggggtcggaaggaccagtctgagggtcatccttgcctacgtgctggaaaaacgtgcctgctgagagagtgccctcaattcccttggtccccagtgcagtgtttggaccaccaagtagccactctattatgtttggtccgtttacacatgcgcccacatccagtttattcctcctggtggggaggctctgccccactcctctgagtccctcacaggactgtgcttggtacttgatctcatgcgagcagagctgggtttaatgagcatttaatctatgctagaaatattatctcgttcattgtcagcaaaactgttaggtgagtagggcagttcattcacaggaatttactgatgggaagttgatattagaggaaagaagtaatttaccacaggcgacacagctactctctgatggggccagaatggaaatccgtaactcggctgtgttctgttcatgtttgttgaatgagtaaatgaatcacaaacagagcaccaagaaaaagctttctcagccttcaaagacccccagcaataaactcaaagtttactggtaaaaaaaaaaaaaaaaaa

SEQ ID NO: 5620 - DNA, 5233 bp, Homo sapiens
gatttcctgagcatgcctagggaatgacaggcatctccacaggcaggctgcatccaccttggctggggtgtcgtcattggctgcctattagaaaaacgacaggacaatgcataccaccgcctcccgactgtaaacataggggatatgtgttcacttagcatggacttctgggaggggccaaggaagggcggtctggagttttattgaatagagcagtgtgtattcggctgcctgcctgcccgcctgcttgctctctggctgtgctcctgcttaaagaaatcagtccttcctttccgacttagtcctcgggaagaagtttcagactacaaggtatcattggaacatttcaagatcatcaaatcaaattccacagggattggtgaccaaccagaaggctcagacatctgattgctgacctgtccagacatcatctggtctccctgaacctgaaatcacaccatggatgattttgagcgtcgcagagaacttagaaggcaaaagagggaggagatgcgactcgaagcagaaagaatcgcctaccagaggaatgacgatgatgaagaggaggcagcccgggaacggcgccgccgagcccgacaggaacggctgcggcagaagcaggaggaagaatccttgggacaggtgaccgaccaggtggaggtgaatgcccagaacagtgtgcctgacgaggaggccaagacaaccaccacaaacactcaagtggaaggggatgatgaggccgcattcctggagcgcctggctcggcgtgaggaaagacgccaaaaacgccttcaggaggctctggagcggcagaaggagttcgacccaacaataacagatgcaagtctgtcgctcccaagcagaagaatgcaaaatgacacagcagaaaatgaaactaccgagaaggaagaaaaaagtgaaagtcgccaagaaagatacgagatagaggaaacagaaacagtcaccaagtcctaccagaagaatgattggagggatgctgaagaaaacaagaaagaagacaaggaaaaggaggaggaggaagaggagaagccaaagcgagggagcattggagaaaatcaggtagaggtgatggtggaagagaaaacaactgaaagccaggaggaaacagtggtaatgtcattaaaaaatgggcagatcagttcagaagagcctaaacaagaggaggagagggaacaaggttcagatgagatttcccatcatgaaaagatggaagaggaagacaaggaaagagctgaggcagagagggcaaggttggaagcagaagaaagagaaagaattaaagccgagcaagacaaaaagatagcagatgaacgagcaagaattgaagcagaagaaaaagcagctgcccaagaaagagaaaggagagaggcagaagagagggaaaggatgagggaggaagagaaaagggcagcagaggagaggcagaggataaaggaggaagagaaaagggcagcagaggagaggcagaggataaaggaggaagagaaaagggcagcagaggagaggcagaggataaaagaggaagagaaaagggcagcagaggagaggcaaagggccagggcagaggaggaagagaaggctaaggtagaagagcagaaacgtaacaagcagctagaagagaaaaaacatgccatgcaagagacaaagataaaaggggaaaaggtagaacagaaaatagaagggaaatgggtaaatgaaaagaaagcacaagaagataaacttcagacagctgtcctaaagaaacagggagaagagaagggaactaaagtgcaagctaaaagagaaaagctccaagaagacaagcctaccttcaaaaaagaagagatcaaagatgaaaagattaaaaaggacaaagaacccaaagaagaagttaagagcttcatggatcgaaagaagggatttacagaagttaagtcgcagaatggagaattcatgacccacaaacttaaacatactgagaatactttcagccgccctggagggagggccagcgtggacaccaaggaggctgagggcgccccccaggtggaagccggcaaaaggctggaggagcttcgtcgtcgtcgcggggagaccgagagcgaagagttcgagaagctcaaacagaagcagcaggaggcggctttggagctggaggaactcaagaaaaagagggaggagagaaggaaggtcctggaggaggaagagcagaggaggaagcaggaggaagccgatcgaaaactcagagaggaggaagagaagaggaggctaaaggaagagattgaaaggcgaagagcagaagctgctgagaaacgccagaagatgccagaagatggcttgtcagatgacaagaaaccattcaagtgtttcactcctaaaggttcatctctcaagatagaagagcgagcagaatttttgaataagtctgtgcagaaaagcagtggtgtcaaatcgacccatcaagcagcaatagtctccaagattgacagcagactggagcagtataccagtgcaattgagggaacaaaaagcgcaaaacctacaaagccggcagcctcggatcttcctgttcctgctgaaggtgtacgcaacatcaagagtatgtgggagaaagggaatgtgttttcatcccccactgcagcaggcacaccaaataaggaaactgctggcttgaaggtaggggtttctagccgcatcaatgaatggctaactaaaaccccagatggaaacaagtcacctgctcccaaaccttctgacttgagaccaggagacgtatccagcaagcggaacctctgggaaaagcaatctgtggataaggtcacttcccccactaaggtttgagacagttccagaaagaacccaagctcaagacgcaggacgagctcagttgtagagggctaattcgctctgttttgtatttatgttgatttactaaattgggttcattatcttttatttttcaatatcccagtaaacccatgtatattatcactatatttaataatcacagtctagagatgttcatggtaaaagtactgcctttgcacaggagcctgtttctaaagaaacccatgctgtgaaatagagacttttctactgatcatcataactctgtatctgagcagtgataccaaccacatctgaagtcaacagaagatccaagtttaaaattgcctgcggaatgtgtgcagtatctagaaaaatgaaccgtagtttttgtttttttaaatacagaagtcatgttgtttctgcactttataataaagcatggaagaaattatcttagtaggcaattgtaacactttttgaaagtaacccatttcagatttgaaatactgcaataatggttgtctttaaaaaaaaaaaagaaatgtactgttaaggtattactttttttcatgctgatgattcatatctaaattacattattatgttagctgacagtggtactgattttttaggttggttgttttgtggatttctttagtagtgatagtagcctgaaccacattttagataactcaattatgtatgtatgtgcatacacatatacaaacacactaatggtagaatgcttttttatgtgctagactattatatttagtagtatgtcattgtaactagccaatatcacagcttttgaaaaattaaaaaatcacactatattaatatttcatatttgccaacagaaacatggcagataggtatcaatatgttttcaatgcctgatgacctataagaagaaagtattgaaaagaagagagattagaactgttagaaggagttgaaattttctaaaagacatagtatttagtttataattaaatgcattcttgaagtccagtgtgaattttattaatgctatcatctcgaccaagctcaaagcctacttattagaaacaatgaagttcacaataggtcataaggtctcttccttttctaaaattgaaagacaagaaatttagtgccaatattgtacagacagaaattccatgtatgagtctcaacaaagactacctttggctaaatgtctagaagcagagaagtaaagtgagcaaaatccagtgttgaggagtcatgacagtactttgatctttatatactctgaagcatttcttcaaacttttctacttttatttgtcattgatacctgtagtaagttgacaatgtggtgaaatttcaaaattatatgtaacttctactagttttactttctcccccaagtcttttttaactcatgatttttacacacacaatccagaacttattatatagcctctaagtctttattcttcacagtagataatgaaagagtcctccagtgtcttggcaaaatgttctagtatagctggatacatacagtggagttctataaactcatacctcagtggacttaaccaaaattgtgttagtctcaattcctaccacactgagggagcctcccaaataactattttcttatctgcagtattcctccagaagagctaaccagggcagggctggcatgagaagtgacatctgcgttacaaagtctatcttcctcataagtctgtaaagagcaattgaatcttctagctttagcaaacctaagccaaaggaaggaaagccacgaagaatgcagaagtcaaaccctcatgacaaagtaggcacaagtctacaataagctaaatcagaatttacaaatacaagtgtcccaggtagcattgactcccgtcattggagtgaaatggatcaaagtttgaattaaggcctatggtaaggtaacattgctttgttgtacttttgaacaagagctcctcctgatcactattacatatttttctagaaaatctaaagttcagaagagaatgtatcactgctgacttttattccaatatttggatggagtaagttttagggtagaattttgttcagtttggatttaatcttttgaaaagtaaattccttgtttactggtttgactataattctctgttatctttacgaggtaaaactgcaagctgactagcatgttctgtgaatctgccattcctaaaaattttataaacacttgatacttttcactgataatggatcgctccaataaacatatattgtgaaaatgcatccacaataaatggaattccttcctgcaaaatgtctttttctcacttatttttatgtacaatattgatagtgagaggtatgtctattataataaagattatggcacagtaaaaaaaaaaaaaaaaaa

SEQ ID NO: 5621 - DNA, 4293 bp, Homo sapiens
gtttctcatagttggcgtcttctaaaggaaaaacactaaaatgaggaactcagcggaccgggagcgacgcagcttgagggaagcatccctagctgttggcgcagaggggcgaggctgaagccgagtggcccgaggtgtctgaggggctggggcaaaggtgaaagagtttcagaacaagcttcctggaacccatgacccatgaagtcttgtcgacatttataccgtctgagggtagcagctcgaaagtagaagaagtggagtgttgccagggacggcagtatctctttgtgtgaccctggcggcttatgggacgttggcttcagacctttgtgatacaccatgctgcgtgggacgatgacggcgtggagaggaatgaggcctgaggtcacactggcttgcctcctcctagccacagcaggctgctttgctgacttgaacgaggtccctcaggtcaccgtccagcctgcgtccaccgtccagaagcccggaggcactgtgatcttgggctgcgtggtggaacctccaaggatgaatgtaacctggcgcctgaatggaaaggagctgaatggctcggatgatgctctgggtgtcctcatcacccacgggaccctcgtcatcactgcccttaacaaccacactgtgggacggtaccagtgtgtggcccggatgcctgcgggggctgtggccagcgtgccagccactgtgacactagccaatctccaggacttcaagttagatgtgcagcacgtgattgaagtggatgagggaaacacagcagtcattgcctgccacctgcctgagagccaccccaaagcccaggtccggtacagcgtcaaacaagagtggctggaggcctccagaggtaactacctgatcatgccctcagggaacctccagattgtgaatgccagccaggaggacgagggcatgtacaagtgtgcagcctacaacccagtgacccaggaagtgaaaacctccggctccagcgacaggctacgtgtgcgccgctccaccgctgaggctgcccgcatcatctaccccccagaggcccaaaccatcatcgtcaccaaaggccagagtctcattctggagtgtgtggccagtggaatcccacccccacgggtcacctgggccaaggatgggtccagtgtcaccggctacaacaagacgcgcttcctgctgagcaacctcctcatcgacaccaccagcgaggaggactcaggcacctaccgctgcatggccgacaatggggttgggcagcccggggcagcggtcatcctctacaatgtccaggtgtttgaaccccctgaggtcaccatggagctatcccagctggtcatcccctggggccagagtgccaagcttacctgtgaggtgcgtgggaaccccccgccctccgtgctgtggctgaggaatgctgtgcccctcatctccagccagcgcctccggctctcccgcagggccctgcgcgtgctcagcatggggcctgaggacgaaggcgtctaccagtgcatggccgagaacgaggttgggagcgcccatgccgtagtccagctgcggacctccaggccaagcataaccccaaggctatggcaggatgctgagctggctactggcacacctcctgtatcaccctccaaactcggcaaccctgagcagatgctgagggggcaaccggcgctccccagacccccaacgtcagtggggcctgcttccccgcagtgtccaggagagaaggggcagggggctcccgccgaggctcccatcatcctcagctcgccccgcacctccaagacagactcatatgaactggtgtggcggcctcggcatgagggcagtggccgggcgccaatcctctactatgtggtgaaacaccgcaaggtcacaaattcctctgacgattggaccatctctggcattccagccaaccagcaccgcctgaccctcaccagacttgaccccgggagcttgtatgaagtggagatggcagcttacaactgtgcgggagagggccagacagccatggtcaccttccgaactggacggcggcccaaacccgagatcatggccagcaaagagcagcagatccagagagacgaccctggagccagtccccagagcagcagccagccagaccacggccgcctctcccccccagaagctcccgacaggcccaccatctccacggcctccgagacctcagtgtacgtgacctggattccccgtgggaatggtgggttcccaatccagtccttccgtgtggagtacaagaagctaaagaaagtgggagactggattctggccaccagcgccatccccccatcgcggctgtccgtggagatcacgggcctagagaaaggcacctcctacaagtttcgagtccgggctctgaacatgctgggggagagcgagcccagcgccccctctcggccctacgtggtgtcgggctacagcggtcgcgtgtacgagaggcccgtggcaggtccttatatcaccttcacggatgcggtcaatgagaccaccatcatgctcaagtggatgtacatcccagcaagtaacaacaacaccccaatccatggcttttatatctattatcgacccacagacagtgacaatgatagtgactacaagaaggatatggtggaaggggacaagtactggcactccatcagccacctgcagccagagacctcctacgacattaagatgcagtgcttcaatgaaggaggggagagcgagttcagcaacgtgatgatctgtgagaccaaagctcggaagtcttctggccagcctggtcgactgccacccccaactctggccccaccacagccgccccttcctgaaaccatagagcggccggtgggcactggggccatggtggctcgctccagcgacctgccctatctgattgtcggggtcgtcctgggctccatcgttctcatcatcgtcaccttcatccccttctgcttgtggagggcctggtctaagcaaaaacatacaacagacctgggttttcctcgaagtgcccttccaccctcctgcccgtatactatggtgccattgggaggactcccaggccaccaggccagtggacagccctacctcagtggcatcagtggacgggcctgtgctaatgggatccacatgaataggggctgcccctcggctgcagtgggctacccgggcatgaagccccagcagcactgcccaggcgagcttcagcagcagagtgacaccagcagcctgctgaggcagacccatcttggcaatggatatgacccccaaagtcaccagatcacgaggggtcccaagtctagcccggacgagggctctttcttatacacactgcccgacgactccactcaccagctgctgcagccccatcacgactgctgccaacgccaggagcagcctgctgctgtgggccagtcaggggtgaggagagcccccgacagtcctgtcctggaagcagtgtgggaccctccatttcactcagggcccccatgctgcttgggccttgtgccagttgaagaggtggacagtcctgactcctgccaagtgagtggaggagactggtgtccccagcaccccgtaggggcctacgtaggacaggaacctggaatgcagctctccccggggccactggtgcgtgtgtcttttgaaacaccacctctcacaatttaggcagaagctgatatcccagaaagactatatattgttttttttttaaaaaaaaaaagaagaaaaaagagacagagaaaattggtatttatttttctattatagccatatttatatatttatgcacttgtaaataaatgtatatgttttataattctggagagacataaggagtcctacccgttgaggttggagagggaaaataaagaagctgccacctaacaggagtcacccaggaaagcaccgcacaggctggcgcgggacagactcctaacctggggcctctgcagtggcaggcgaggctgcaggaggcccacagataagctggcaagaggaaggatcccaggcacatggttcatcacgagcatgagggaacagcaaggggcacggtatcacagcctggagacacccacacagatggctggatccggtgctacgggaaacattttcctaagatgcccatgagaacagaccaagatgtgtacagcactatgagcattaaaaaaccttccagaatcaataatccgtggcaacatatctctgtaaaaacaaacactgtaacttctaaataaatgtttagtcttccctgtaaccttcaaaaaaaaaaaaaaa

SEQ ID NO: 5622 - DNA, 723 bp, Homo sapiens
gcctcaagccgacgcagcggcctactctcgcactgcagacggggaaactgaggcctgaggcggccggggtggggcagacctcccggcgagcccgagcccccgcccccggctagccccgccctggcccgtaagaagcacccggggcgcgaggcgaaggcgcacagcgcggggccaggctgggtccagcagcgcgatggcagctcagcggctgggcaagcgcgtgctgagcaagctgcagtctccatcgcgggcccgcgggccagggggcagtcccggggggctgcagaagcggcacgcgcgcgtcaccgtcaagtatgaccggcgggagctgcagcggcggctggacgtggagaagtggatcgacgggcgcctggaggagctgtaccgcggcatggaggcagacatgcccgatgagatcaacattgatgaattgttggagttagagagtgaagaggagagaagccggaaaatccagggactcctgaagtcatgtgggaaacctgtcgaggacttcatccaggagctgctggcaaagcttcaaggcctccacaggcagcccggcctccgccagccaagcccctcccacgacggcagcctcagccccctccaggaccgggcccggactgctcacccctgaccctcttgcactctccctgccccccggacgccgcccagcttgcttgtgtataagttgtatttaatggttctgtaacaataaaaaaa

SEQ ID NO: 5623 - DNA, 6009 bp, Homo sapiens
cccagccattcagctgatccgaggcaaagagccggcacttgccccagcccagcctgcttgaaggacctacaggtttgtctcttccagatcagaactgaggaacaaaaacccccatcctgggaaaaatggggaagctgatagctgatcagcttccttgggttttgctgatgacacaagagagctttgcctgaagatggaaacactggagtcagaactgacctgccctatttgtctggagctctttgaggaccctcttctactgccctgcgcacacagcctctgcttcaactgcgcccaccgcatcctagtatcacactgtgccaccaacgagtctgtggagtccatcaccgccttccagtgccccacctgccggcatgtcatcaccctcagccagcgaggtctagacgggctcaagcgcaacgtcaccctacagaacatcatcgacaggttccagaaagcatcagtgagcgggcccaactctcccagcgagacccgtcgggagcgggcctttgacgccaacaccatgacctccgccgagaaggtcctctgccagttttgtgaccaggatcctgcccaggacgctgtgaagacctgtgtcacttgtgaagtatcctactgtgacgagtgcctgaaagccactcacccgaataagaagccctttacaggccatcgtctgattgagccaattccggactctcacatccgggggctgatgtgcttggagcatgaggatgagaaggtgaatatgtactgtgtgaccgatgaccagttaatctgtgccttgtgtaaactggttgggcggcaccgcgatcatcaggtggcagctttgagtgagcgctatgacaaattgaagcaaaacttagagagtaacctcaccaaccttattaagaggaacacagaactggagacccttttggctaaactcatccaaacctgtcaacatgttgaagtcaatgcatcacgtcaagaagccaaattgacagaggagtgtgatcttctcattgagatcattcagcaaagacgacagattattggaaccaagatcaaagaagggaaggtgatgaggcttcgcaaactggctcagcagattgcaaactgcaaacagtgcattgagcggtcagcatcactcatctcccaagcggaacactctctgaaggagaatgatcatgcgcgtttcctacagactgctaagaatatcaccgagagagtctccatggcaactgcatcctcccaggttctaattcctgaaatcaacctcaatgacacatttgacacctttgccttagatttttcccgagagaagaaactgctagaatgtctggattaccttacagctcccaaccctcccacaattagagaagagctctgcacagcttcatatgacaccatcactgtgcattggacctccgatgatgagttcagcgtggtctcctacgagctccagtacaccatattcaccggacaagccaacgtcgttagtctgtgtaattcggctgatagctggatgatagtacccaacatcaagcagaaccactacacggtgcacggtctgcagagcggcaccaagtacatcttcatggtcaaggccatcaaccaggcgggcagccgcagcagtgagcctgggaagttgaagacaaacagccaaccatttaaactggatcccaaatctgctcatcgaaaactgaaggtgtcccatgataacttgacagtagaacgtgatgagtcatcatccaagaagagtcacacacctgaacgcttcaccagccaggggagctatggagtagctggaaatgtgtttattgatagtggccggcattattgggaagtggtcataagtggaagcacatggtatgccattggtcttgcttacaaatcagccccgaagcatgaatggattgggaagaactctgcttcctgggcgctctgccgctgcaacaataactgggtggtgagacacaatagcaaggaaatccccattgagcctgccccccacctccggcgcgtgggcatcctgctggactatgataacggctctatcgccttttatgatgctttgaactccatccacctctacaccttcgacgtcgcatttgcgcagcctgtttgccccaccttcaccgtgtggaacaagtgtctgacgattatcactgggctccctatcccagaccatttggactgcacagagcagctgccgtgagcgtctggccacatggagctgctttctggggaacagtaaggttcaggccactatttaggggactgagaaagcacaggcttcatgagtgtaatgaaatctcaccagaagtgtcccgaaatcggctcagatagggctcaaaacaagagattcctctccttttactgtgtcttgtattaagtacgggctttaataatttctttaatttttttgtatttagaggaaaatctatagattatttataagagaaacataatcaggattacaacttttaggaattacttggttttgcacattaagaggcccataagtttatcagctatttacaaccttcatttcatcacaatctgtgggcttacaaaaaaacaaaaacttttgtagttttgtatgttactcatcttcttacctgatatcccatgatgatcccatggtaggtcttctcacctcgatggtgcataacaggatgtgtttgaacctagtaggggaggaaacaggctttcttactctggtttaatttgaagtgttttaattgtgatgtcaaaaagttgtatcagatcaactaaaatggagagcaagacagagaatgaaaagagttgattttggacctcggaccttgccgtggctaaatctttaccttctcatagctgatgggataatgttggaaagaaaggttctgaatcctttggccacattttgccctgcttctctcagggttaagggttctggaagaacattaagaatgagattgcaattgaaaatagtcattttgaatcctattgattattcaaaaattcaggctgatttgtcttttatcagaggtaggattctgttttatagtatagaatctactttatccttccttttaatagttcctttagacctgtgaaatttcttcactacatttaatagttctcctatttcccgctcccccatatcaattttccttttgtctccggggctgagtaaataaacatgttctgtcacaaatagcagcaccactttggattgattttgctctccaggacatcagcacatggccctgatcagcactaccacatccaaacataagtcactgaaaaacacttaatatttatgagttggtaatgacaagggacattgtataaagtactatttgctagattcatgcctcaaaagttattataaacagacctttattaaacacatcttgaaagatgtagaagtccctctatagtctagtatagtttacaatagagttgtaagaccaaaaaaaaaaaaaaaaaattcaaactcgttattcaggaacctgcttataaaatgtcagctgggattctttgcatgccaatctgatgcgttggaatggtccatgaattaaggctttcttgagcagttcttggcccagaactctggcattggttctagtttgatgaagggcatgacctctataaatggtttcaattgctaaaatatttacctgggatactgggtcagccattttgactgagcagactagtggatttagacattgtttttagttattttgtttttaaccaaatcaaccaactgcctccctgaaataagtcaatgaactcattgtttcagcatcacgtggccaaaggtcatgtgattgcaaatctggatttcaagggaggccaagccagcttcctgggtccttccatcctcttccctagcagacactctcctttttcttaacagatagattctatatatttactatattatttatacccagatgaatattttgatagatacctaagacaatttcacatctaaaagatggacgcctcaatggaaaaaaaacaatctttctctggaaaccttataggtttttctttttattacaatataaaagcaatgtgtgtttgccttctctgagtaaactgaaagggttgtctcagtaatttttacatacattttgggtaactggataatggatattttaatgcactttgtacactaacaggttctaaataaaagggtctaaaactcagcttctgagtttttaaaatcacggtctccaggtaccaataaatgctacagtttgccttatgatgttaacataaaacacttagtagaaggacaatatttccatgaaaataatgtttttcaatattaagaagttactactcaaattttcacagtaagccatttagggtatgtttggctatttttataaggacatgagagattatgtcataattttgttgtggaagtctcactcttggctaacttaaaagcattgtggatagtagcagttactagttccaggttgtcatatttacaggaaaatatgtatatggtgaaaggccaccgtgtttaattactataatgatgtagaaaagattcccgtgtgaattttttttttgaaagtctaaaaaatgtatgctgtaaaaatttgctgcagtgtaattttgcattctctttaaactgattgaggtcacagtattttattatttggggtcctcaccacaggaaacactgcgatacaggggcaaaagagatggcagtgccaattaaattaatacaacaaaatcaatgcagcaccaaccaagactgccaggtctggtgtcatgggtatgcccagagcccaggagttcagaagggccctaagcctgatttaatgctctgctgttgatgtcttgaaattcttaacaatttttgaacaaggggcctgcgttttcacttcgcactgggccttgcaaattacatagcgagtgctcataaaagaactcagaaacgtggtacctctcttcctggtggatacaaataaagaaatctggatccaaagttgaaagttgctggcgatatcattcaagtaggactctaaatagtggattaagatgagggtgggcctgggtgaagattctttccagctttaaaagaaagtgacttcaaaaactgactgcaaatattgacgatggtttctgctggaggaaaagaaacagcttgaatacagacaggcttttttattacggtactgatatattgaccttaaacttgctgaggaactgaactaacgtcctccagtgaccgtggaattccatctcagctccaggaacatgcagatacctgcaaagagacacgcatatatgctggcatacatgtgcatttggtgttgggaagttgaccatctggtctatcttaataaaatggtaaaaagcacaccaagacaatgatgggggcaggaggatgtttttgaaaacagcgcttctcaaccagtgctcgattttgccccccaggagacatttggcaatgcaatggcaacttttggttgtcgcagccggggaagggaagctaccagcatctagtgcgtagaggtcatggacgccgttaaacatcctacagtgcaagcgcagcccccgaccacgaagagttgtcttgctcaaatatcaacagtgctgcagtgtagaaacttgatcgttggttttcttttaatgcaaaactctcataaaaacctttcacttttcctgtcattgattatatgcttgatacacccaaaaagaaaaggggaggggcaccaattcacctacactccagtggctccatcacctttaaaaatatttataaaatagttccaaaaatctgatatctgaaaagcaatccaagcctgtgtaaatgggaatcactgataagtatcatcatctgtatcagcttggcttggacatgaaaaattgattctctttatgtcactccttgcacctggacaaattcaatccccggtacttaagtcacactgccaagccctcggccctgactattgtcttgattgctgttcctttctggttcaaaataaaatcatttttgtggcaccaaga

SEQ ID NO: 5624 - DNA, 2644 bp, Homo sapiens
caacagaatactgaaaaatgaagcctaaaatgaagtattcaaccaacaaaatttccacagcaaagtggaagaacacagcaagcaaagccttgtgtttcaagctgggaaaatcccaacagaaggccaaagaagtttgccccatgtactttatgaagctccgctctggccttatgataaaaaaggaggcctgttactttaggagagaaaccaccaaaaggccttcactgaaaacaggtagaaagcacaaaagacatctggtactcgctgcctgtcaacagcagtctactgtggagtgctttgcctttggtatatcaggggtccagaaatatactagagcacttcatgattcaagtatcacaggaatttcacctattacagagtatcttgcttctctaagcacatacaatgatcaatccattacttttgctttggaggatgaaagttatgagatatatgttgaagacttgaaaaaagatgaaaagaaagataaggtgttactgagttactatgagtctcaacacccctcaaatgaatcaggtgacggtgttgatggtaagatgttaatggtaaccctgagtcctacaaaagacttctggttgcatgccaacaacaaggaacactctgtggagctccataagtgtgaaaaaccactgccagaccaggccttctttgtccttcataatatgcactccaactgtgtttcatttgaatgcaagactgatcctggagtgtttataggtgtaaaggataatcatcttgctctgattaaagtagactcttctgagaatttgtgtactgaaaatatcttgtttaagctctctgaaacttagttgatggaaacctgtgagtcttgggttgagtacccaaatgctaccactggagaaggaatgagagataaagaaagagacaggtgacatctaagggaaatgaagagtgcttagcatgtgtggaatgttttccatattatgtataaaaatattttttctaatcctccagttattcttttatttccctctgtataactgcatcttcaatacaagtatcagtatattaaatagggtattggtaaagaaacggtcaacattctaaagagatacagtctgacctttacttttctctagtttcagtccagaaagaacttcatatttagagctaaggccactgaggaaagagccatagcttaagtctctatgtagacagggatccattttaaagagctacttagagaaataattttccacagttccaaacgataggctcaaacactagagctgctagtaaaaagaagaccagatgcttcacagaattatcattttttcaactggaataaaacaccaggtttgtttgtagatgtcttaggcaacactcagagcagatctcccttactgtcaggggatatggaacttcaaaggcccacatggcaagccaggtaacataaatgtgtgaaaaagtaaagataactaaaaaatttagaaaaataaatccagtatttgtaaagtgaataacttcatttctaattgtttaatttttaaaattctgatttttatatattgagtttaagcaaggcattcttacacgaggaagtgaagtaaattttagttcagacataaaatttcacttattaggaatatgtaacatgctaaaacttttttttttttaaagagtactgagtcacaacatgttttagagcatccaagtaccatataatccaactatcatggtaaggccagaaatcttctaacctaccagagcctagatgagacaccgaattaacattaaaatttcagtaactgactgtccctcatgtccatggcctaccatcccttctgaccctggcttccagggacctatgtcttttaatactcactgtcacattgggcaaagttgcttctaatccttatttcccatgtgcacaagtctttttgtattccagcttcctgataacactgcttactgtggaatattcatttgacatctgtctcttttcatttcttttaactaccatgcccttgatatatcttttgcacctgctgaacttcatttctgtatcacctgacctctggatgccaaaacgtttattctgctttgtctgttgtagaattttagataaagctattaatggcaatatttttttgctaaacgtttttgttttttactgtcactagggcaataaaatttatactcaaccatataataacattttttaactactaaaggagtagtttttattttaaagtcttagcaatttctattacaacttttcttagacttaacacttatgataaatgactaacatagtaacagaatctttatgaaatatgaccttttctgaaaatacatacttttacatttctactttattgagacctattagatgtaagtgctagtagaatataagataaaagaggctgagaattaccatacaagggtattacaactgtaaaacaatttatctttgtttcattgttctgtcaataattgttaccaaagagataaaaataaaagcagaatgtatatcatcccatctgaaaaacactaattattgacatgtgcatctgtacaataaacttaaaatgattattaaataatcaaatatatctactacattgtttatattattgaataaagtatattttccaaatgt

SEQ ID NO: 5625 - DNA, 3143 bp, Homo sapiens
tcttagttggtagtctgttatggaaacgctctttactgttattgtagtaccgtggtgacaacatgccattgaaatggaaaacgagctctcctgctatctggaaattcccagttcctgtgcttaaaacatccaggtcaactccactttctccagcatacatatctctcgtggaagaggaagaccaacacatgaaattgtcccttggaggcagcgaaatgggcctctcatcccatttgcagtcttccaaggcaggacctacacgcatctttaccagcaatacccacagttctgtggtgttacagggctttgaccagcttcgacttgaaggattgctttgtgatgtgaccctgatgccaggtgacacagatgatgctttccctgtgcatagagtcatgatggcatctgctagtgattacttcaaggctatgttcacaggtggaatgaaagaacaagatttaatgtgcattaaacttcatggtgtgagcaaagtcggtctaaggaaaattattgatttcatttatactgcaaagctttctcttaatatggacaaccttcaagacacgctggaagctgccagtttcctacagattctgccagttttggacttctgtaaagtgtttctcatatctggggtcactttagacaactgtgttgaagttggacggattgccaacacctacaatctaaccgaagtggataaatacgttaacagtttcgtcttgaagaattttcctgcattgctgagcacaggggagttcttgaaactcccttttgagcgtcttgccttcgtgctttccagtaatagccttaagcactgtactgaacttgagctctttaaggctacctgtcgttggcttcgcctggaagagcctcggatggactttgctgcaaaattaatgaagaacatacgatttccactgatgacaccacaggagctcattaattacgtgcaaacggtggatttcatgagaactgacaatacttgtgtgaatttgcttttggaagccagcaattaccaaatgatgccatatatgcagccagttatgcagtcagacaggactgccattaggtctgacaccactcacttggttacactaggaggagtgctgaggcagcagctggttgtcagtaaggaattgcgcatgtatgatgaaaaggcccatgagtggaaatcgttagcccccatggatgccccaaggtaccagcatggcatcgccgtcattggaaattttctctatgtggttggcggacagagtaattatgatacaaaaggaaaaacggcagttgatacagtcttcagatttgatcctcgatacaataaatggatgcaagttgcatctttaaatgaaaagcgcaccttcttccacctaagtgccctcaaaggatatctgtatgcagttggtgggcgaaatgcagcaggtgaactgcccacagtagaatgttacaatccaagaacaaatgaatggacctatgttgccaaaatgagtgagccccactatggccatgctggaactgtgtatggaggagtgatgtatatttcaggaggaattactcatgatactttccaaaaggagctcatgtgctttgaccctgatactgacaaatggatccagaaggcgccaatgaccactgtcagaggtctgcattgcatgtgtacagtgggagaaaggctctatgtcattggtggcaatcacttcagaggaacaagtgattatgatgatgtcctaagctgtgaatactattcacctatccttgaccagtggaccccaattgctgccatgttaagagggcagagtgatgttggggtcgctgtcttcgaaaataaaatctatgtggttggggggtattcttggaataatcgttgtatggtagagatagtgcagaaatatgatccagataaagatgaatggcataaggtttttgatctgccagaatcccttggtggcattcgtgcttgcacactcacagtttttccaccagaagaaaccacaccatcaccttctagagagtcccctctttctgcaccttaagatcatctctacaactaagatgctgtagttctatctttgcaatgtgtcataaattctcttctttttcccccttaagtagtatatatgttaggattaccctctggtaattgatacagatattggaaaaaagacaacattgatgttatttgtgctctttgtttggcctagaatgtttataaagtggtaacacaaccattctggaaatgtatcccatagaagctgatgtttaacatatgaaaaaaaaagtattgtctataaaatgtttcttcagtactttttaaatgctgtgtattgggtgtaaggtatttgtcatcttacattagtaaacccaataagccaagttgaaggtggattatagtaaatgtacaactgtgctcactaggcttcaagtaaaaagttttcctttcatctttgactgtaagatgtcaaagggaggcagcctgcttgaacaggaaacaatacacaaaaggttgccaactcgcatgagctacctccctcttttcataaagtatttttgacatatctgtcaacccacttgactgtgtgggtgcattgagaacacaaagtttcctagacacacaggagaagtagcttaaattcactaatattaatttaaaaagcagcatgaaccctctacttataaacaagggtttggtgtttttaaagtgtgtatacatacatacacatacacacatgcacatatgtcaaatataatttttttaaaaattgagtggcacatcaaagaaatgtgaaattaaaaagaattcttccaaaaagcagcttccattaaaatgggaattcagtatgcacatactgaatgcatatatgtagaaccatacagaatttaggtggataagggctagaaattttgagcaacaaaatttgtcacttgaccagattttatcttcaaaaactgtattctactccttctcctttgctgttgaggtaacttgcatattatatgtattctgtatactcagttcataaggttatttagcacaaagtatagcagcttcacctggagagctgcttttgctcagtaaattcaacttccatgttttatctttttttgttcaataaaaacatttaatgtcaaaaaaaaaaaaaaaaaaa

SEQ ID NO: 5626 - DNA, 3896 bp, Homo sapiens
ccttccgcagctgccgcttcagtccgaaggaggaagggaaccaacccactttctcggcgccgcggctcttttctaaaagtaatgtgaaaacctttgcatcttctgatagtctagccaaggtccaagaagtagcaagctggcttttggaaatgaatcaggaactgctctctgtgggcagcaaaagacgacgaactggaggctctctgagaggtaacccttcctcaagccaggtagatgaagaacagatgaatcgtgtggtagaggaggaacagcaacagcaactcagacaacaagaggaggagcacactgcaaggaatggtgaagttgttggagtagaacctagacctggaggccaaaatgattcccagcaaggacagttggaagaaaacaataatagatttatttcggtagatgaggactcctcaggaaaccaagaagaacaagaggaagatgaagaacatgctggtgaacaagatgaggaggatgaggaggaggaggagatggaccaggagagtgacgattttgatcagtctgatgatagtagcagagaagatgaacatacacatactaacagtgtcacgaactccagtagtattgtggacctgcccgttcaccaactctcctccccattctatacaaaaacaacaaaaatgaaaagaaagttggaccatggttctgaggtccgctctttttctttgggaaagaaaccatgcaaagtctcagaatatacaagtaccactgggcttgtaccatgttcagcaacaccaacaacttttggggacctcagagcagccaatggccaagggcaacaacgacgccgaattacatctgtccagccacctacaggcctccaggaatggctaaaaatgtttcagagctggagtggaccagagaaattgcttgctttagatgaactcattgatagttgtgaaccaacacaagtaaaacatatgatgcaagtgatagaaccccagtttcaacgagacttcatttcattgctccctaaagagttggcactctatgtgctttcattcctggaacccaaagacctgctacaagcagctcagacatgtcgctactggagaattttggctgaagacaaccttctctggagagagaaatgcaaagaagaggggattgatgaaccattgcacatcaagagaagaaaagtaataaaaccaggtttcatacacagtccatggaaaagtgcatacatcagacagcacagaattgatactaactggaggcgaggagaactcaaatctcctaaggtgctgaaaggacatgatgatcatgtgatcacatgcttacagttttgtggtaaccgaatagttagtggttctgatgacaacactttaaaagtttggtcagcagtcacaggcaaatgtctgagaacattagtgggacatacaggtggagtatggtcatcacaaatgagagacaacatcatcattagtggatctacagatcggacactcaaagtgtggaatgcagagactggagaatgtatacacaccttatatgggcatacttccactgtgcgttgtatgcatcttcatgaaaaaagagttgttagcggttctcgagatgccactcttagggtttgggatattgagacaggccagtgtttacatgttttgatgggtcatgttgcagcagtccgctgtgttcaatatgatggcaggagggttgttagtggagcatatgattttatggtaaaggtgtgggatccagagactgaaacctgtctacacacgttgcaggggcatactaatagagtctattcattacagtttgatggtatccatgtggtgagtggatctcttgatacatcaatccgtgtttgggatgtggagacagggaattgcattcacacgttaacagggcaccagtcgttaacaagtggaatggaactcaaagacaatattcttgtctctgggaatgcagattctacagttaaaatctgggatatcaaaacaggacagtgtttacaaacattgcaaggtcccaacaagcatcagagtgctgtgacctgtttacagttcaacaagaactttgtaattaccagctcagatgatggaactgtaaaactatgggacttgaaaacgggtgaatttattcgaaacctagtcacattggagagtggggggagtgggggagttgtgtggcggatcagagcctcaaacacaaagctggtgtgtgcagttgggagtcggaatgggactgaagaaaccaagctgctggtgctggactttgatgtggacatgaagtgaagagcagaaaagatgaatttgtccaattgtgtagacgatatactccctgcccttccccctgcaaaaagaaaaaaagaaaagaaaaagaaaaaaatcccttgttctcagtggtgcaggatgttggcttggggcaacagattgaaaagacctacagactaagaaggaaaagaagaagagatgacaaaccataactgacaagagaggcgtctgctgtctcatcacataaaaggcttcacttttgactgagggcagctttgcaaaatgagactttctaaatcaaaccaggtgcaattatttctttattttcttctccagtggtcattgggcagtgttaatgctgaaacatcattacagattctgctagcctgttcttttaccactgacagctagacacctagaaaggaactgcaataatatcaaaacaagtactggttgactttctaattagagagcatctgcaacaaaaagtcatttttctggagtggaaaagcttaaaaaaattactgtgaattgtttttgtacagttatcatgaaaagcttttttttttttttttttgccaaccattgccaatgtcaatcaatcacagtattagcctctgttaatctatttactgttgcttccatatacattcttcaatgcatatgttgctcaaaggtggcaagttgtcctgggttctgtgagtcctgagatggatttaattcttgatgctggtgctagaagtaggtcttcaaatatgggattgttgtcccaaccctgtactgtactcccagtggccaaacttatttatgctgctaaatgaaagaaagaaaaaagcaaattatttttttttattttttttctgctgtgacgttttagtcccagactgaattccaaatttgctctagtttggttatggaaaaaagactttttgccactgaaacttgagccatctgtgcctctaagaggctgagaatggaagagtttcagataataaagagtgaagtttgcctgcaagtaaagaattgagagtgtgtgcaaagcttattttcttttatctgggcaaaaattaaaacacattccttggaacagagctattacttgcctgttctgtggagaaacttttctttttgagggctgtggtgaatggatgaacgtacatcgtaaaactgacaaaatattttaaaaatatataaaacacaaaattaaaataaagttgctggtcagtcttagtgttttacagtatttgggaaaacaactgttacagttttattgctctgagtaactgacaaagcagaaactattcagtttttgtagtaaaggcgtcacatgcaaacaaacaaaatgaatgaaacagtcaaatggtttgcctcattctccaagagccacaactcaagctgaactgtgaaagtggtttaacactgtatcctaggcgatcttttttcctccttctgtttatttttttgtttgttttatttatagtctgatttaaaacaatcagattcaagttggttaattttagttatgtaacaacctgacatgatggaggaaaacaacctttaaagggattgtgtctatggtttgattcacttagaaattttattttcttataacttaagtgcaataaaatgtgttttttcatgtta

SEQ ID NO: 5627 - DNA, 5229 bp, Homo sapiens; identical to SEQ ID NO: 5399

SEQ ID NO: 5628 - DNA, 3156 bp, Homo sapiens
ttgagtcctgccctgggagggacagtatctgtttagatttgcgtctaaatttaaaccctgatcgtcggcctccctccccgctccccaccctcccctcccctccccttcctccctccctccctcctcctccttcctcgttctctcgcgcagggcccccgcggccggggcagtcccgcagccgagcgcagccgggcgcgcgccaccgcccactcgccctgtgcccgccgcagcccgaaactggccacggccgggaacggaggggacagcggggatcgtgagctccggcccgggcgagcgggtgcgtctgccgcagagtcggcacctgaaggacatggaggaaagaccggcagagaccaatgccaatgtggacaactcggcgtccccctcggtggcccagctggccgggcggtttagggagcaggcggctgcagccaaggagacaccagccagtaaaccaacccgaaggaaaccggcctgttccctccccctgttcccccccaaggtagacctgggccagaatggtgaggagaaatcaccacccaatgcgagccagcctcctaaattcaaggtcaagagctcgcctctgattgagaagcttcaggccaatttaacctttgagccagctgctctactgcctggggcctcacccaagagtcctggactcaaggctatggtgtcgccatttcacagcccaccttctacccccagcagccctggtgtgcgatctaggcccagcgaggcagaggaggtgcctgtcagcttcgaccagccccctgaaggcagtcatctgccctgttacaacaaggtgcggacgaggggctcaataaaaaggcgccctccctccaggcgattccgaaggtcacagtcagactgtggagaacttggagatttcagggcggtggagtcatctcagcagaacggtgctaaggaagaggatggggatgaagtgttgccatccaagagcaaggccccaggatcccctttgtccagtgagggagcagcgggagagggagtgagaaccctgggacctgctgaaaagcctcctctgaggaggtcacccagcaggacagagaagcaggaggaggacagggccacagaggaagccaagaacggtgaaaaggccaggcggagttcagaggaggtggacggccagcacccggcccaagaggaggtcccggaatcgccccagacctctggcccagaggcagaaaataggtgtgggagccccagggaggaaaagccagctggagaggaagcagagatggaaaaggctacagaggtgaagggggagagggtgcaaaatgaagaggtgggacctgaacatgacagccaagaaacaaagaagctggaggagggagctgcagtgaaggagaccccccacagtccccctggaggagtgaagggcggagatgtccccaagcaggaaaaaggcaaggaaaaacaacaggagggggcagtgctcgagccaggctgcagcccccagaccggccctgcccagctggagaccagcagtgaggtccagagcgagccagcagtccccaagccggaggatgacactcctgtccaggacactaaaatgtgaagaacagctcattgtgccccagtgatgaagttgctggacacatctctttgcaggtagcagcaacagttgtagcagcagcagacgaagccattgcagaggcagaatatgctgagtgtctggagtcagcctgaagacacagggtggattatttcctggcctccacaccaaacgttcccttgcagatggagactgaatctgagggcagcagacttttatcagcttgagtttatgtcatttgatggacttggttcaacaacaagaacttacttaaaacaatgtactgtggtgatgagtcccaggggcactggtcagcctgtggagccctggatgctatccacacccacctatccctgcagctaatttagctgatctctaatttaactgagctctaatttagctgatcagattttgcttgggtaaagttcctttttaatgttctaaagtgtttacggttctcaaatatcagttaaaaactaattttaggtggccataaacataaaatagaaaccctgtaagttacagaagaccctaaattgtatcaaaaccctagagacaacttttcaatttgatccaaatttgaactggccaaccagtctttaaaacactggactagaagagataatgattgaaacatttaaaaaaaaaaagtgctccattcgcaggagcttttcctgtcctgtggttttccagttggtgaccaccatgggaggtcgctggctcggctcactcccttctcccacccttgagaatgtggagaactcccatggagaggcagaatggcaggaggtttcatgtcccgcgttgcatctcctcctgaaagaaaagcagtgatacctgaataatgctggctctccgattgatcctgtgaggatgaatttgcatttccagaatccttgagcatggattagatgtttcctgggaggtgccttgagtaccattatgtgcaagctacataattaaaacatttttcttagtttccctgggaagcttttcttgactcacagcccaggttcttctgcccaacacaaaaggagtgagttggggtctttagtctcttcttattgggtagctcttgctttaatattctgtttggtgagtgtaagggattctgcaagggacagggggcctgactacccagtctttgacttgtatcctctcccctcttcatacactcctgctgaaaaatgttaatccaaatacacatttaaacttagggtcggtccttattctgatttgagtattttaatgtctcagtgtgctgatttggtagttggaagaattattcttctggaggtctgttagactacatcctacactgacttcagaaaacagtctgtcagacaaaaaggccttatgtcaccactggtacctcagtttcctcatcccatttacagtttttctaactccagggtagtgtttagtgttaatatttgggatatattttttttcaaaactgtttttaagtagtttgtaatttgtaacaaacttgtaacctggttgggactgatattgtcatagctatgataaactttggatattagcagaatttgggaaaaaaaaaaaaaaaaaaaaaa

SEQ ID NO: 5629 - DNA, 3400 bp, Homo sapiens
ggaaccgccgccggtatccgcgtccgcagcgccgccagccaggcgagagccgtgtgggatcccagcgcccgcactcccgcccccgccaaggagccaggaatggcacaactagagaggagcgccatctctggcttcagctctaagtccaggcgaaactcattcgcatatgatgttaagcgtgaagtatacaatgaggagacctttcaacaggaacacaaaaggaaggcctcctcttctgggaacatgaacatcaacatcaccaccttcagacaccacgtccagtgccgctgctcatggcacaggttcctacgatgcgtgcttacaatctttcccttcctagaatggatgtgtatgtatcgattaaaggattggcttctgggagacttacttgctggtataagtgttggccttgtgcaagttccccaaggcctgacacttagtttgctggcaaggcaactgattcctcctctcaacatcgcttatgcagctttctgttcttcggtaatctatgtaatttttggatcgtgtcatcaaatgtccattggttccttcttcctggtgagtgctctgctgatcaacgttctgaaagtgagcccattcaacaacggtcaactggtcatgggatctttcgtcaagaatgagttttcggccccctcctaccttatgggctataataaatccttgagtgtggtggcaaccacaacttttctgactgggattattcagctaataatgggcgtattgggtttgggcttcattgccacttaccttccggagtctgcaatgagtgcttacctggctgctgtggcacttcatatcatgctgtcccagctgactttcatctttgggattatgattagtttccatgccggtcccatctccttcttctatgacataattaattactgtgtagctctcccaaaagcgaattccaccagcattctagtatttctaactgttgttgttgctctgcgaatcaacaaatgtatcagaatttctttcaatcagtatcccattgagtttcccatggaattatttctgattattggcttcactgtgattgcaaacaagataagcatggccacagaaaccagccagacgcttattgacatgattccttatagctttctgcttcctgtaacaccagatttcagccttcttcccaagataattttacaagccttctccttatctttggtgagctcctttctgctcatatttctgggcaagaagattgccagtcttcacaattacagtgtcaattccaaccaggatttaatagccatcggcctttgcaatgtcgtcagttcatttttcagatcttgtgtgtttactggtgctattgctaggactattatccaggataaatctggaggaagacaacagtttgcatctctggtaggcgcaggtgtgatgctgctcctgatggtgaagatgggacactttttctacacactgccaaatgctgtgctggctggtattattctgagcaacgtcattccctaccttgaaaccatttctaacctacccagcctgtggaggcaggaccaatatgactgtgctctttggatgatgacattctcatcttcaattttcctgggactggacattggactaattatctcagtagtttctgctttcttcatcaccactgttcgttcacacagagctaagattcttctcctgggtcaaatccctaacaccaacatttatagaagcatcaatgattatcgggagatcatcaccattcctggggtgaaaatcttccagtgctgcagctcaattacatttgtaaatgtttactacctaaagcataagctgttaaaagaggttgatatggtaaaggtgcctcttaaagaagaagaaattttcagcttgtttaattcaagtgacaccaatctacaaggaggaaagatttgcaggtgtttctgcaactgtgatgatctggagccgctgcccaggattctttacacagagcgatttgaaaataaactggatcccgaagcatcctccattaacctgattcactgctcacattttgagagcatgaacacaagccaaactgcatccgaagaccaagtgccatacacagtatcgtccgtgtctcagaaaaatcaagggcaacagtatgaggaggtggaggaagtttggcttcctaataactcatcaagaaacagctcaccaggactgcctgatgtggcggaaagccaggggaggagatcactcatcccttactcagatgcgtctctactgcccagtgtccacaccatcatcctggatttctccatggtacactacgtggattcacgggggttagtcgtattaagacagatatgcaatgcctttcaaaacgccaacattttgatactcattgcagggtgtcactcttccatagtcagggcatttgagaggaatgatttctttgacgctggcatcaccaagacccagctgttcctcagcgttcacgacgccgtgctgtttgccttgtcaaggaaggtcataggctcctctgagttaagcatcgatgaatccgagacagtgatacgggaaacctactcagaaacagacaagaatgacaattcaagatataaaatgagcagcagttttctaggaagccaaaaaaatgtaagtccaggcttcatcaagatccaacagcctgtagaagaggagtcggagttggatttggagctggaatcagaacaagaggctgggctgggtctggacctagacctggatcgggagctggagcctgaaatggagcccaaggctgagaccgagaccaagacccagaccgagatggagccccagcctgagactgagcctgagatggagcccaaccccaaatctaggccaagagctcacacttttcctcagcagcgttactggcctatgtatcatccgtctatggcttccacccagtctcagactcagactcggacatggtcagtggagaggagacgccatcctatggattcatactcaccagagggcaacagcaatgaagatgtctaggagatgaactagaaataaggggtcagataatgctggcaaatcctcctacccaaaaaggggtcaattgtccagagacctagactggatacgaactagcagtacttccttcctgactgtgactcctactacctgccagccttcttccttgctctgcgctgggatcatactcccaaatcacattactaaatgccaacaattatctctgaattccctatccaggctcccctcatttcaccttcagcatatattctagtcatgaatttccttcttcacacaccccacatctctgggctttgtgccagaccatctctaacttaatcctctcatccctgttcccctttctccaaagagatgaagctcaaataaaatgtataactctagtaaaaaa

SEQ ID NO: 5630 - DNA, 7852 bp, Homo sapiens
ggcgctgagcgagctcggagcccgcgctgtgcgcctgcggccggggcgccccgccgagcgccggtgccccggctcccgggccgccttcgccgcgcgggaaggattcttcaaaattaacagaaaccaattcgggccagctgaagagaaaaaataaaggtggctcccggctgcctctgctgcagttcagagcaacttcaggagcttcccagccgagagcttcaggacgcctttcctgtcccactggcccagttgccacaacaaacaacagagaagacggtgaccatgggggatgtgaagctggttgcctcgtcacacatttccaaaacctccctcagtgtggatccctcaagagttgactccatgcccctgacagaggcccctgctttcattttgccccctcggaacctctgcatcaaagaaggagccaccgccaagttcgaagggcgggtccggggttacccagagccccaggtgacatggcacagaaacgggcaacccatcaccagcgggggccgcttcctgctggattgcggcatccgggggactttcagccttgtgattcatgctgtccatgaggaggacaggggaaagtatacctgtgaagccaccaatggcagtggtgctcgccaggtgacagtggagttgacagtagaaggaagttttgcgaagcagcttggtcagcctgttgtttccaaaaccttaggggatagattttcagctccagcagtggagacccgtcctagcatctggggggagtgcccaccaaagtttgctaccaagctgggccgagttgtggtcaaagaaggacagatgggacgattctcctgcaagatcactggccggccccaaccgcaggtcacctggctcaagggaaatgttccactgcagccgagtgcccgtgtgtctgtgtctgagaagaacggcatgcaggttctggaaatccatggagtcaaccaagatgacgtgggagtgtacacgtgcctggtggtgaacgggtcggggaaggcctcgatgtcagctgaactttccatccaaggtttggacagtgccaataggtcatttgtgagagaaacaaaagccaccaattcagatgtcaggaaagaggtgaccaatgtaatctcaaaggagtcgaagctggacagtctggaggctgcagccaaaagcaagaactgctccagcccccagagaggtggctccccaccctgggctgcaaacagccagcctcagcccccaagggagtccaagctggagtcatgcaaggactcgcccagaacggccccgcagaccccggtccttcagaagacttccagctccatcaccctgcaggccgcaagagttcagccggaaccaagagcaccaggcctgggggtcctatcaccttctggagaagagaggaagaggccagctcctccccgtccagccaccttccccaccaggcagcctggcctggggagccaagatgttgtgagcaaggctgctaacaggagaatccccatggagggccagagggattcagcattccccaaatttgagagcaagccccaaagccaggaggtcaaggaaaatcaaactgtcaagttcagatgtgaagtttccgggattccaaagcctgaagtggcctggttcctggaaggcacccccgtgaggagacaggaaggcagcattgaggtttatgaagatgctggctcccattacctctgcctgctgaaagcccggaccagggacagtgggacatacagctgcactgcttccaacgcccaaggccagctgtcctgtagctggaccctccaagtggaaaggcttgccgtgatggaggtggccccctccttctccagtgtcctgaaggactgcgctgttattgagggccaggattttgtgctgcagtgctccgtacgggggaccccagtgccccggatcacttggctgctgaatgggcagcccatccagtacgctcgctccacctgcgaggccggcgtggctgagctccacatccaggatgccctgccggaggaccatggcacctacacctgcctagctgagaatgccttggggcaggtgtcctgcagcgcctgggtcaccgtccatgaaaagaagagtagcaggaagagtgagtaccttctgcctgtggctcccagcaagcccactgcacccatcttcctgcagggcctctctgatctcaaagtcatggatggaagccaggtcactatgactgtccaagtgtcagggaatccaccccctgaagtcatctggctgcacaatgggaatgagatccaagagtcagaggacttccactttgaacagagaggaactcagcacagcctttgtatccaggaagtgttcccggaggacacgggcacgtacacctgcgaggcctggaacagcgctggagaggtccgcacccaggccgtgctcacggtacaagagcctcacgatggcacccagccctggttcatcagtaagcctcgctcagtgacagcctccctgggccagagtgtcctcatctcctgcgccatagctggtgacccctttcctaccgtgcactggctcagagatggcaaagccctctgcaaagacactggccacttcgaggtgcttcagaatgaggacgtgttcaccctggttctaaagaaggtgcagccctggcatgccggccagtatgagatcctgctcaagaaccgggttggcgaatgcagttgccaggtgtcactgatgctacagaacagctctgccagagcccttccacgggggagggagcctgccagctgcgaggacctctgtggtggaggagttggtgctgatggtggtggtagtgaccgctatgggtccctgaggcctggctggccagcaagagggcagggttggctagaggaggaagacggcgaggacgtgcgaggggtgctgaagaggcgcgtggagacgaggcagcacactgaggaggcgatccgccagcaggaggtggagcagctggacttccgagacctcctggggaagaaggtgagtacaaagaccctatcggaagacgacctgaaggagatcccagccgagcagatggatttccgtgccaacctgcagcggcaagtgaagccaaagactgtgtctgaggaagagaggaaggtgcacagcccccagcaggtcgattttcgctctgtcctggccaagaaggggacttccaagacccccgtgcctgagaaggtgccaccgccaaaacctgccaccccggattttcgctcagtgctgggtggcaagaagaaattaccagcagagaatggcagcagcagtgccgagaccctgaatgccaaggcagtggagagttccaagcccctgagcaatgcacagccttcagggcccttgaaacccgtgggcaacgccaagcctgctgagaccctgaagccaatgggcaacgccaagcctgccgagaccctgaagcccatgggcaatgccaagcctgatgagaacctgaaatccgctagcaaagaagaactcaagaaagacgttaagaatgatgtgaactgcaagagaggccatgcagggaccacagataatgaaaagagatcagagagccaggggacagccccagccttcaagcagaagctgcaagatgttcatgtggcagagggcaagaagctgctgctccagtgccaggtgtcttctgaccccccagccaccatcatctggacgctgaacggaaagaccctcaagaccaccaagttcatcatcctctcccaggaaggctcactctgctccgtctccatcgagaaggcactgcctgaggacagaggcttatacaagtgtgtagccaagaatgacgctggccaggcggagtgctcctgccaagtcaccgtggatgatgctccagccagtgagaacaccaaggccccagagatgaaatcccggaggcccaagagctctcttcctcccgtgctaggaactgagagtgatgcgactgtgaaaaagaaacctgcccccaagacacctccgaaggcagcaatgccccctcagatcatccagttccctgaggaccagaaggtacgcgcaggagagtcagtggagctgtttggcaaagtgacaggcactcagcccatcacctgtacctggatgaagttccgaaagcagatccaggaaagcgagcacatgaaggtggagaacagcgagaatggcagcaagctcaccatcctggccgcgcgccaggagcactgcggctgctacacactgctggtggagaacaagctgggcagcaggcaggcccaggtcaacctcactgtcgtggataagccagaccccccagctggcacaccttgtgcctctgacattcggagctcctcactgaccctgtcctggtatggctcctcatatgatgggggcagtgctgtacagtcctacagcatcgagatctgggactcagccaacaagacgtggaaggaactagccacatgccgcagcacctctttcaacgtccaggacctgctgcctgaccacgaatataagttccgtgtacgtgcaatcaacgtgtatggaaccagtgagccaagccaggagtctgaactcacaacggtaggagagaaacctgaagagccgaaggatgaagtggaggtgtcagatgatgatgagaaggagcccgaggttgattaccggacagtgacaatcaatactgaacaaaaagtatctgacttctacgacattgaggagagattaggatctgggaaatttggacaggtctttcgacttgtagaaaagaaaactcgaaaagtctgggcagggaagttcttcaaggcatattcagcaaaagagaaagagaatatccggcaggagattagcatcatgaactgcctccaccaccctaagctggtccagtgtgtggatgcctttgaagaaaaggccaacatcgtcatggtcctggagatcgtgtcaggaggggagctgtttgagcgcatcattgacgaggactttgagctgacggagcgtgagtgcatcaagtacatgcggcagatctcggagggagtggagtacatccacaagcagggcatcgtgcacctggacctcaagccggagaacatcatgtgtgtcaacaagacgggcaccaggatcaagctcatcgactttggtctggccaggaggctggagaatgcggggtctctgaaggtcctctttggcaccccagaatttgtggctcctgaagtgatcaactatgagcccatcggctacgccacagacatgtggagcatcggggtcatctgctacatcctagtcagtggcctttcccccttcatgggagacaacgataacgaaaccttggccaacgttacctcagccacctgggacttcgacgacgaggcattcgatgagatctccgacgatgccaaggatttcatcagcaatctgctgaagaaagatatgaaaaaccgcctggactgcacgcagtgccttcagcatccatggctaatgaaagataccaagaacatggaggccaagaaactctccaaggaccggatgaagaagtacatggcaagaaggaaatggcagaaaacgggcaatgctgtgagagccattggaagactgtcctctatggcaatgatctcagggctcagtggcaggaaatcctcaacagggtcaccaaccagcccgctcaatgcagaaaaactagaatctgaagaagatgtgtcccaagctttccttgaggctgttgctgaggaaaagcctcatgtaaaaccctatttctctaagaccattcgcgatttagaagttgtggagggaagtgctgctagatttgactgcaagattgaaggatacccagaccccgaggttgtctggttcaaagatgaccagtcaatcagggagtcccgccacttccagatagactacgatgaggacgggaactgctctttaattattagtgatgtttgcggggatgacgatgccaagtacacctgcaaggctgtcaacagtcttggagaagccacctgcacagcagagctcattgtggaaacgatggaggaaggtgaaggggaaggggaagaggaagaagagtgaaacaaagccagagaaaagcagtttctaagtcatattaaaaggactatttctctaaaactcaaaaaaaaaaaaaaaactcaagatagtaaaagcacctagtgtgatagattatcggttaggtcatttgtgggttgattcttcagaaacagcagttgatacctagcagcgttattgatgggcattaatctatgttagttggcaccttaagatactagtgcagctagatttcatttagggaaatcaccagtaacttgactgaccaattgattttagagagaaagtaaccaaaccaaatatttatctgggcaaagtcataaattctccacttgaatgcgctcatgaaaaataaggccaaaacaagagttctgggccacagctcagcccagagggttcctggggatgggaggcctctctctccccaccccctgactctagagaactgggttttctcccagtactccagcaattcatttctgaaagcagttgagccactttattccaaagtacactgcagatgttcaaactctccatttctctttccccttccacctgccagttttgctgactctcaacttgtcatgagtgtaagcattaaggacattatgcttcttcgattctgaagacaggtccctgctcatggatgactctggcttccttaggaaaatatttttcttccaaaatcagtaggaaatctaaacttatcccctctttgcagatgtctagcagcttcagacatttggttaagaacccatgggaaaaaaaaaatccttgctaatgtggtttcctttgtaaaccaggattcttatttgtgctgttatagaatatcagctctgaacgtgtggtaaagatttttgtgtttgaatataggagaaatcagtttgctgaaaagttagtcttaattatctattggccacgatgaaacagatttcaactgataaagagctggagaactccatgtactttggaatctcctccaagatagccagagtttaatacatcttcattctcaacactctccaaagaacttgacctaccttatgggttccatatttttcttcttaaatgtgcatcaatcatgccttgcccccaacctttaaatatattcttagacctggtaaatgcactcagacttgcgtctttaggaatttttaactttctttcactacattggcacttaaattttttctttataaagctttttgaaggtcataaacaaagaccataattgatgatagacctaatacatttcctctgtgtgtgtgtgtaacattccaaatactttttttttcttttccactgtttgtaaggtgcaacaatttaatatttttaagggactttttaagagttccttaagaaccaatttaaaattacttcagtgcaatcctacacagtatcaacattagaattttgatattagtcttatgttatcttccattctatttttatctgctttttgctgctagtttcaaactgccagtatttttccttttgcttttaaaatagttacaatatttttcatgatagccacagtattgccacagtttattataataaagggtttttatttgatttagcgcattcaaagcttttttctatcacttttgtgttcagaatataacctttgtgtgcgtgtatgttgtgtgtgtgcatgtgtggcgtatatgtgtgttacaggttaatgccttcttggaattgtgttaatgttctcttggtttattatgccatcagaatggtaaatgagaacactacaactgtagtcagctcacaatttttaaataaaggataccacagtgcatgctgtttgttcaaaaaaaaaaaaaaaaaa

SEQ ID NO: 5631 - DNA, 2748 bp, Homo sapiens
agcgggtgcggggcgggaccggcccggcctatatattgggttggcgccggcgccagctgagccgagcggtagctggtctggcgaggttttatacacctgaaagaagagaatgtcaagacgaagtagccgtttacaagctaagcagcagccccagcccagccagacggaatccccccaagaagcccagataatccaggccaagaagaggaaaactacccaggatgtcaaaaaaagaagagaggaggtcaccaagaaacatcagtatgaaattaggaattgttggccacctgtattatctggggggatcagtccttgcattatcattgaaacacctcacaaagaaataggaacaagtgatttctccagatttacaaattacagatttaaaaatctttttattaatccttcacctttgcctgatttaagctggggatgttcaaaagaagtctggctaaacatgttaaaaaaggagagcagatatgttcatgacaaacattttgaagttctgcattctgacttggaaccacagatgaggtccatacttctagactggcttttagaggtatgtgaagtatacacacttcatagggaaacattttatcttgcacaagacttttttgatagatttatgttgacacaaaaggatataaataaaaatatgcttcaactcattggaattacctcattattcattgcttccaaacttgaggaaatctatgctcctaaactccaagagtttgcttacgtcactgatggtgcttgcagtgaagaggatatcttaaggatggaactcattatattaaaggctttaaaatgggaactttgtcctgtaacaatcatctcctggctaaatctctttctccaagttgatgctcttaaagatgctcctaaagttcttctacctcagtattctcaggaaacattcattcaaatagctcagcttttagatctgtgtattctagccattgattcattagagttccagtacagaatactgactgctgctgccttgtgccattttacctccattgaagtggttaagaaagcctcaggtttggagtgggacagtatttcagaatgtgtagattggatggtaccttttgtcaatgtagtaaaaagtactagtccagtgaagctgaagacttttaagaagattcctatggaagacagacataatatccagacacatacaaactatttggctatgctggaggaagtaaattacataaacaccttcagaaaagggggacagttgtcaccagtgtgcaatggaggcattatgacaccaccgaagagcactgaaaaaccaccaggaaaacactaaagaagataactaagcaaacaagttggaattcaccaagattgggtagaactggtatcactgaactactaaagttttacagaaagtagtgctgtgattgattgccctagccaattcacaagttacactgccattctgattttaaaacttacaattggcactaaagaatacatttaattatttcctatgttagctgttaaagaaacagcaggacttgtttacaaagatgtcttcattcccaaggttactggatagaagccaaccacagtctataccatagcaatgtttttcctttaatccagtgttactgtgtttatcttgataaactaggaattttgtcactggagttttggactggataagtgctaccttaaagggtatactaagtgatacagtactttgaatctagttgttagattctcaaaattcctacactcttgactagtgcaatttggttcttgaaaattaaatttaaacttgtttacaaaggtttagttttgtaataaggtgactaatttatctatagctgctatagcaagctattataaaacttgaatttctacaaatggtgaaatttaatgttttttaaactagtttatttgccttgccataacacattttttaactaataaggcttagatgaacatggtgttcaacctgtgctctaaacagtgggagtaccaaagaaattataaacaagataaatgctgtggctccttcctaactggggctttcttgacatgtaggttgcttggtaataacctttttgtatatcacaatttgggtgaaaaacttaagtaccctttcaaactatttatatgaggaagtcactttactactctaagatatccctaaggaatttttttttttaatttagtgtgactaaggctttatttatgtttgtgaaactgttaaggtcctttctaaattcctccattgtgagataaggacagtgtcaaagtgataaagcttaacacttgacctaaacttctattttcttaaggaagaagagtattaaatatatactgactcctagaaatctatttattaaaaaaagacatgaaaacttgctgtacataggctagctatttctaaatattttaaattagcttttctaaaaaaaaaatccagcctcataaagtagattagaaaactagattgctagtttattttgttatcagatatgtgaatctcttctccctttgaagaaactatacatttattgttacggtatgaagtcttctgtatagtttgtttttaaactaatatttgtttcagtattttgtctgaaaagaaaacaccactaattgtgtacatatgtattatataaacttaaccttttaatactgtttatttttagcccattgtttaaaaaataaaagttaaaaaaatttaactgcttaaaagtaaaaaaaaaaaaaaaaaaa

SEQ ID NO: 5632 - DNA, 7591 bp, Homo sapiens
tccatccctgaccgggccgaggctgctggatgccgcgtctccgcttctgctgcctgccgggcgggctccggtggccgcagcaaagtggggcaccaaggccctgtgctaagcactcataatcctctgggggtgctacccctacaaacagcacccccaccatgtttaacctaatgaagaaagacaaggacaaagatggcgggcggaaggagaagaaggagaaaaaggagaaaaaggagcggatgtcagcggcagagcttcggagcctggaggagatgagcctgcgacgtggcttcttcaacctgaaccgctcctccaagcgtgaatccaagacgcgcctggaaatctccaaccccatccccatcaaggtggccagcggctctgacctgcacctgactgacattgactccgatagtaaccggggcagcgtcatcctggactcgggccacctaagtacagccagctccagcgatgacctcaagggtgaggagggtagcttccgtggctcggtgctgcagcgggcagccaagttcggctcactggccaagcagaactcacagatgattgtcaagcgcttttccttctcccagcgtagccgggatgagagcgcctcagaaacctcgacgccctcagagcactctgccgccccctcgccacaggtggaggtgaggactctagagggacagctggtgcagcatcctggcccaggcatccctcgaccagggcaccgatcccgagcccctgagctagtgactaaaaagttcccagtcgacctgcgcctgccccccgtggtgcccctgcccccacctaccctccgggagctggagctgcaacgacggcccactggagactttggcttctccctgcggcgcacaaccatgctggatcggggccccgagggccaggcctgtcggcgtgtggtccactttgctgagcctggtgcaggcaccaaggacctggccctggggctggtgccaggagatcgactggtggagattaatgggcacaatgtggagagcaagtccagggatgagattgtggagatgatccggcagtcaggggacagcgtgcggctcaaggtgcagcccattccagagctcagcgagctcagcaggagctggctgcggagcggcgagggacctcgcagggagccatccgatgcgaaaacagaagaacagattgcagcagaagaggcctggaatgagacggagaaggtgtggctggtccatagggacggcttctcactggccagtcaactcaaatctgaggagctcaacttgcctgaggggaaggtgcgtgtgaagctggaccacgatggggccatcctggatgtggatgaggatgacgttgagaaggctaatgctccctcctgcgaccgtctggaggatctggcctcactggtgtacctcaatgagtccagcgtcctgcacaccttgcgccagcgctatggcgctagcctgctgcacacgtatgctggccccagcctgctggttcttggcccccgtggggcccctgctgtgtactctgagaaggtgatgcacatgttcaagggttgtcggcgggaggacatggcaccccacatctatgcagtggcccagaccgcatacagggcgatgctgatgagccgtcaggatcagtcaatcatcctcctgggcagtagtggcagtggcaagaccaccagctgccagcatctggtgcagtacctggccaccatcgcgggcatcagcgggaacaaggtgttttctgtggagaagtggcaggctctgtacaccctcctggaagcctttgggaacagccccaccatcattaatggcaatgccacccgcttctcccagatcctctccctggactttgaccaagctggccaggtggcctcagcctccattcagacaatgcttctggagaagctgcgtgtggctcggcgcccagccagtgaagccacattcaacgtcttctactacctgctggcctgtggggatggcaccctcaggacagagctccacctcaaccacttggcagagaacaatgtgtttgggattgtgccactggccaagcctgaggaaaagcagaaggcagctcagcagtttagtaagctgcaggcggccatgaaggtgctgggcatctcccccgatgaacagaaggcctgctggttcattctggctgccatctaccacctgggggctgcgggagccaccaaagaagctgctgaagctgggcgcaagcagtttgcccgccatgagtgggcccagaaggctgcgtacctactgggctgcagcctggaggagctgtcctcagccatcttcaagcaccagcacaagggtggcaccctgcagcgctccacctccttccgccagggccccgaggagagtggcctgggagatgggacaggcccgaaactgagtgcactggagtgccttgagggcatggcggccggcctctacagcgagctcttcacccttctcgtctccctggtgaatagggctctcaagtccagccagcactcactctgctccatgatgattgtcgacaccccgggcttccagaaccctgagcagggtgggtcagcccgcggagcctcctttgaggagctgtgccacaactacacccaagaccggctgcagaggctcttccacgagcgcaccttcgtgcaggagttggaaagatacaaggaggagaacatcgagctggcgtttgacgacttggaacccccgacggatgactctgtggctgctgtggaccaggcctcccatcagtccctggtccgctcgctggcccgcacagacgaggcgaggggcctgctctggctattggaagaggaggctctggtgccaggggccagtgaggacaccctcctggagcgccttttctcctattatggcccccaggaaggtgacaaaaaaggccaaagcccccttctgcacagcagcaaaccacaccactttctcctgggccacagccatggcaccaactgggtagagtacaatgtgactggctggctgaactacaccaagcagaacccagccacccagaatgccccccggctcctgcaggactcccagaaaaaaatcatcagcaacctgtttctgggccgcgcaggcagtgccacggtgctctctggctccatcgcgggcctggagggcggctcgcagctggcactgcgccgggccaccagcatgcggaaaacctttaccacaggcatggcggctgtcaaaaagaagtcactgtgcatccagatgaagctacaggtggacgccctcatcgacaccatcaagaagtcaaagctgcattttgtgcactgcttcctgcctgtagctgagggctgggctggggagccccgttccgcctcctcccgccgagtcagcagcagcagtgagctggacctgccctcgggagaccactgcgaggctgggctcctgcagctcgacgtgcccctgctccgcacccagctccgcggctcccgcctgctcgatgccatgcgcatgtaccgccaaggttaccctgaccacatggtgttttccgagttccgccgccgctttgatgtcctggccccgcacctgaccaagaaacacgggcgtaactacatcgtggtggatgaaaggcgggcagtggaggagctgctggagtgcttggatctggagaagagcagctgctgcatgggcctgagccgggtgttcttccgggcgggcaccttggcacggctggaggagcagcgggatgaacaaaccagcaggaacctaaccctgttccaagcagcctgcaggggctacctggcccgccagcacttcaagaagagaaagatccaggacctggccattcgctgtgtacagaagaacatcaagaagaacaaaggggtgaaggactggccctggtggaagctttttaccacagtgaggcccctcatcgaagtacagctgtcagaggagcagatccggaacaaagacgaggagatccagcagctgcggagcaagctcgagaaggcggagaaggagaggaacgagctgcggctcaacagtgaccggctggagagccggatctcagagctgacatcggagctgacagatgagcgtaacacaggagagtccgcctcccagctgctggacgcggagacagcagagaggctccgggctgagaaggagatgaaggaactgcagacccagtacgatgcactgaagaagcagatggaggttatggaaatggaggtgatggaggcccgtctcatccgggcagcggagatcaacggggaagtggatgatgatgatgcaggtggcgagtggcggctgaagtatgagcgggctgtgcgggaggtggacttcaccaagaaacggctccagcaggagtttgaggacaagctggaggtggagcagcagaacaagaggcagctggaacggcggctcggggacctgcaggcagatagtgaggagagtcagcgggctctgcagcagctcaagaagaagtgccagcgactgacggctgagctgcaagacaccaagctgcacctggagggccagcaggtccgcaaccacgaactggagaagaagcagaggaggtttgacagtgagctctcgcaggcgcatgaggaggcccagcgggagaagctgcagcgggagaagctgcagcgggagaaggacatgctcctcgctgaggctttcagcctgaagcagcaactagaggaaaaagacatggacattgcagggttcacccagaaggttgtgtctctagaggcagagctccaggacatttcttcccaagagtccaaggatgaggcttctctggccaaggtcaagaaacagctccgggacctggaggccaaagtcaaggatcaggaagaagagctggatgagcaggcagggaccatccagatgctggaacaggccaagctgcgtctggagatggagatggagcggatgagacagacccattctaaggagatggagagtcgggatgaggaggtggaggaggcccggcagtcgtgtcagaagaagttaaaacagatggaggtgcagctagaggaagagtatgaggacaagcagaaggttctgcgagagaagcgggagctggagggcaagctcgccaccctcagcgaccaggtgaaccggcgggactttgagtcagagaagcggctgcggaaggacctgaagcgcaccaaggccctgctggcagatgcccagctcatgctggaccacctgaagaacagtgctcccagcaagcgagagattgcccagctcaagaaccagctggaggagtcagagttcacctgtgcggcagccgtgaaagcacggaaagcaatggaggtggagatcgaagacctgcacctgcagattgatgacatcgccaaagccaagacagcgctggaggagcagctgagccgccttcagcgtgagaagaatgagatccagaaccggctggaggaagatcaggaagacatgaacgaattgatgaagaagcacaaggctgccgtggctcaggcttcccgggacctggctcagataaatgatctccaagctcagctagaagaagccaacaaagagaagcaggagctgcaggagaagctacaagccctccagagccaggtggagttcctggagcagtccatggtggacaagtccctggtgagcaggcaggaagctaagatacgggagctggagacacgcctggagtttgaaaggacgcaagtgaaacggctggagagcctggctagccgtctcaaggaaaacatggagaagctgactgaggagcgggatcagcgcattgcagccgagaaccgggagaaggaacagaacaagcggctacagaggcagctccgggacaccaaggaggagatgggcgagcttgccaggaaggaggccgaggcgagccgcaagaagcacgaactggagatggatctagaaagcctggaggctgctaaccagagcctgcaggctgacctaaagttggcattcaagcgcatcggggacctgcaggctgccattgaggatgagatggagagtgatgagaatgaggacctcatcaacagtttgcaggacatggtgacaaagtatcagaaaagaaagaataaacttgagggagactctgatgtggactcggagctggaggaccgtgttgacggggtcaagtcctggttgtcaaaaaacaagggaccttccaaggcagcttctgatgatggcagcttaaagagttccagccccaccagctactggaagtcccttgcccctgatcggtcagatgatgagcacgaccctctcgacaacacctccagaccgcgatactcccacagttatctgagtgacagcgacacagaggccaagctgacggagactaacgcatagcccaggggagtggttggcagccctctcaccccagggcctgtggctgcctgggcacctctcccaggaagtggtggggcaccggtctcccccacccgactgctgatctgcatgggaaacaccctgaccttcttctgtcaggggcactttccaggctatgggtgtctgatgtctccacgtggaagaggtgggggaaagaggagtttctgaagagaactttttgctcctctgtctcaaaatgccagactcttggcttctaccctgtgtcaccgtgggcagtggcaggtggcctggcactgcatggagccagcacgttgacctccctctcagctccctgctcagggacggtggacaggttgcctactgggacactctaggttgctgggtccatggggaggattgggggaggagaagcagtgccttccctctcgtgtggggtgggggctctctcttcttggtgcctgctgtctttctactttttaatttaaatacccaacctctccatcacagctgcatccctgagagtgggagggggctgtagtggtagctggggctcccaagaacgactcgggaatgtcatctccatcttcacccttcagagagcagtcctttctctgtgcagctggagacgctggtgaggagagccgggtccaggttcttaagaatgaggtgcggaggggctctccggtgctgctgggctgggttgagcaagcctacgcagacaagtgtgtgtgtggaccatccgcacctccagcccccaccccaccctctttgtctcagcgtgttatgtgcaatgacctatttaaggtaaacccattccaactacagcagttcagggctgatccaagcactgcctccctcctgctctgtccaggtggtctggaccataaactcaacttgagagggaaggcttggggttgaggacttgtgatcagaaaaactgaagatggaagttttggccggtgctcattagacatgagtcctcactctgtgtcctgagcccgtgtcattcttccaacctccctgcccccacacacttatcccagacacaacaccatgtggtctggaggtcccagcccccaccctaaaaaggttatccctgagaactccaccagacttgggagcccaagtgcagtgcctggtgctgctcccatctgccgccccccttctctcctgcaattggtttgtactcactgggctgtgctctcccctgtttacccgatgtatggaaataaaggcccttttcctcctggctgcgccagtaaaaaaaa

SEQ ID NO: 5633 - DNA, 1985 bp, Homo sapiens
gcggctgtttgcgccccttctgcctcccgcgcggccagcaccggtacttgcgagccatgagccgccaactgacccatttcccccgcggggagcgcctgggcttcagcggttgctccgcggtcctctctggcgggatcggcagcagctccgcctcattccgggcccgggtcaagggctcggcctcctttggcagcaagagcctctcctgccttgggggcagccgaagcctggcgctcagcgctgctgcacggcggggcggcggccgcctgggcggcttcgtgggcaccgccttcggcagcgccgggctggggcccaagtgtccctccgtgtgcccacccgggggcatccctcaggtcaccgtcaacaagagcctcctggccccgctcaacgtggagatggaccccgagatccagagggtgcgcgcccaggagcgggagcagatcaaggcgctaaacaacaagttcgcctccttcatcgacaaggtgcggttcctggagcagcagaatcaggtgctagagaccaagtggaacctcctacagcagctggacttgaacaactgcaggaagaacctggagcccatttatgagggctacatcagcaacctgcagaagcagctggagatgctgtctggggacggggtgaggctggattcggagctgaggaacatgcaggatttggtggaggactacaagaagaggtatgaggtggagattaacagacgcacagctgctgagaatgagtttgtggtgctcaagaaggacgtggatgctgcttacatgaataaggttgagctccaggccaaggtggactccttgacagatgagattaaattcttcaagtgcctttatgaaggggagatcactcagatccagtcccacatcagcgacacgtccatcgtcctgtcaatggacaacaaccgggatctggacctggacagcatcattgccgaggtccgtgcccagtacgaggagattgccctaaagagcaaggccgaggctgagaccctgtaccagaccaagatccaggagctgcaggtcacagcaggccagcatggggatgacctcaagctcaccaaggctgaaatctctgagctcaaccgcctgatccagaggatccgctcagagatagggaatgtgaagaagcagtgtgccgatctggagacggccatcgccgacgctgaacagcggggggactgcgccctgaaagatgcccgggccaagctggatgagctggagggcgccctgcaccaggccaaggaggagctggcacggatgctgcgtgagtaccaggagctcgtgagcctgaagctggccctggatatggagatcgccacctaccgcaagctgctggagagcgaggagtgcaggatgtctggcgaatatccaaattctgtgagcatctccgtcatcagcagcaccaatgctggggcaggaggggctggcttcagcatgggctttggcgcctcaagcagttatagctacaaaactgcagctgcagacgtcaagaccaaaggcagctgtggcagtgagctcaaggatccccttgccaaaacctcggggagcagctgtgccaccaaaaaggcctccagatgatggacaagtggttggctctgtgagcagaaggcttcccaactcacccgtctcctccctctccttccctgggctccctttccaagtcaagaaatgctttgtctgtcactacagtcccaaccccatttcctctccctgttgtcctcaaggtgtgatgcttcgatgcaaggagtccagtcaggagctctctcagtggcctccttcttggtcccgtttcgttgggtcattgcctgaaatgcaaagacaacacttacccaggatgtttccccaaggccagctacaagcccctctgcccccatgcctttcttgggccttcactaccaagggactctcttcatcttctgattgggattgtgtccagtcctctgcttcttctgcaataaatgattaaatctg

SEQ ID NO: 5634 - DNA, 3868 bp, Homo sapiens
cgctcgctcgcagagaagccgcggcccatggagcccgccggcccggcccccggccgcctcgggccgctgctctgcctgctgctcgccgcgtcctgcgcctggtcaggagtggcgggtgaggaggagctgcaggtgattcagcctgacaagtccgtgttggttgcagctggagagacagccactctgcgctgcactgcgacctctctgatccctgtggggcccatccagtggttcagaggagctggaccaggccgggaattaatctacaatcaaaaagaaggccacttcccccgggtaacaactgtttcagacctcacaaagagaaacaacatggacttttccatccgcatcggtaacatcaccccagcagatgccggcacctactactgtgtgaagttccggaaagggagccccgatgacgtggagtttaagtctggagcaggcactgagctgtctgtgcgcgccaaaccctctgcccccgtggtatcgggccctgcggcgagggccacacctcagcacacagtgagcttcacctgcgagtcccacggcttctcacccagagacatcaccctgaaatggttcaaaaatgggaatgagctctcagacttccagaccaacgtggaccccgtaggagagagcgtgtcctacagcatccacagcacagccaaggtggtgctgacccgcgaggacgttcactctcaagtcatctgcgaggtggcccacgtcaccttgcagggggaccctcttcgtgggactgccaacttgtctgagaccatccgagttccacccaccttggaggttactcaacagcccgtgagggcagagaaccaggtgaatgtcacctgccaggtgaggaagttctacccccagagactacagctgacctggttggagaatggaaacgtgtcccggacagaaacggcctcaaccgttacagagaacaaggatggtacctacaactggatgagctggctcctggtgaatgtatctgcccacagggatgatgtgaagctcacctgccaggtggagcatgacgggcagccagcggtcagcaaaagccatgacctgaaggtctcagcccacccgaaggagcagggctcaaataccgccgctgagaacactggatctaatgaacggaacatctatattgtggtgggtgtggtgtgcaccttgctggtggccctactgatggcggccctctacctcgtccgaatcagacagaagaaagcccagggctccacttcttctacaaggttgcatgagcccgagaagaatgccagagaaataacacaggacacaaatgatatcacatatgcagacctgaacctgcccaaggggaagaagcctgctccccaggctgcggagcccaacaaccacacggagtatgccagcattcagaccagcccgcagcccgcgtcggaggacaccctcacctatgctgacctggacatggtccacctcaaccggacccccaagcagccggcccccaagcctgagccgtccttctcagagtacgccagcgtccaggtcccgaggaagtgaatgggaccgtggtttgctctagcacccatctctacgcgctttcttgtcccacagggagccgccgtgatgagcacagccaacccagttcccggagggctggggcggtgcaggctctgggacccaggggccagggtggctcttctctccccacccctccttggctctccagcacttcctgggcagccacggccccctccccccacattgccacatacctggaggctgacgttgccaaaccagccagggaaccaacctgggaagtggccagaactgcctggggtccaagaactcttgtgcctccgtccatcaccatgtgggttttgaagaccctcgactgcctccccgatgctccgaagcctgatcttccagggtggggaggagaaaatcccacctcccctgacctccaccacctccaccaccaccaccaccaccaccaccaccactaccaccaccacccaactggggctagagtggggaagatttcccctttagatcaaactgccccttccatggaaaagctggaaaaaaactctggaacccatatccaggcttggtgaggttgctgccaacagtcctggcctcccccatccctaggctaaagagccatgagtcctggaggaggagaggacccctcccaaaggactggagacaaaaccctctgcttccttgggtccctccaagactccctggggcccaactgtgttgctccacccggacccatctctcccttctagacctgagcttgcccctccagctagcactaagcaacatctcgctgtggacgcctgtaaattactgagaaatgtgaaacgtgcaatcttgaaactgaggtgttagaaaacttgatctgtggtgttttgttttgttttttttcttaaaacaacagcaacgtgatcttggctgtctgtcatgtgttgaagtccatggttgggtcttgtgaagtctgaggtttaacagtttgttgtcctggagggattttcttacagcgaagacttgagttcctccaagtcccagaaccccaagaatgggcaagaaggatcaggtcagccactccctggagacacagccttctggctgggactgacttggccatgttctcagctgagccacgcggctggtagtgcagccttctgtgaccccgctgtggtaagtccagcctgcccagggctgctgagggctgcctcttgacagtgcagtcttatcgagacccaatgcctcagtctgctcatccgtaaagtggggatagtgaagatgacacccctccccaccacctctcataagcactttaggaacacacagagggtagggatagtggccctggccgtctatcctacccctttagtgaccgcccccatcccggctttctgagctgatccttgaagaagaaatcttccatttctgctctcaaaccctactgggatcaaactggaataaattgaagacagccagggggatggtgcagctgtgaagctcgggctgattccccctctgtcccagaaggttggccagagggtgtgacccagttaccctttaacccccacccttccagtcgggtgtgagggcctgaccgggcccagggcaagcagatgtcgcaagccctatttattcagtcttcactataactcttagagttgagacgctaatgttcatgactcctggccttgggatgcccaagggatttctggctcaggctgtaaaagtagctgagccatcctgcccattcctggaggtcctacaggtgaaactgcaggagctcagcatagacccagctctctgggggatggtcacctggtgatttcaatgatggcatccaggaattagctgagccaacagaccatgtggacagctttggccagagctcccgtgtggcatctgggagccacagtgacccagccacctggctcaggctagttccaaattccaaaagattggcttgtaaaccttcgtctccctctcttttacccagagacagcacatacgtgtgcacacgcatgcacacacacattcagtattttaaaagaatgttttcttggtgccattttcattttattttattttttaattcttggagggggaaataagggaataaggccaaggaagatgtatagctttagctttagcctggcaacctggagaatccacataccttgtgtattgaaccccaggaaaaggaagaggtcgaaccaaccctgcggaaggagcatggtttcaggagtttattttaagactgctgggaaggaaacaggccccattttgtatatagttgcaacttaaactttttggcttgcaaaatatttttgtaataaagatttctgggtaataatga

SEQ ID NO: 5635 - DNA, 3470 bp, Homo sapiens
atacacacagactcacagcgagaccgacacacactcccatacactcacacacacaactgcaggcagcgaggctcgggaagtcaggccggcttttcgccccggcgccttctctgctccagccggccgggtctccctgggggcccggagctcggccgggccgcgcagccccgttagaggacgagctcggcggacccccgctcctccatgggcaaacgcgggcggccgcgcaaggaggcgcgctgcgagggcgcggggctggcccccgccgcgcccccggctgtgccccccgccgtggccgcgccccagcccccggccctgcccgaggaccccgctggggccaagcccaggtgccccttctcagacattttcaacaccagcgagaactcgatggagaagcacatcaacacttttctgcagaacgtgcagattctgctcgaggccgccagctacctggagcagatcgagaaagaaaacaaaaagtgtgaacatggctacgcctcttcattcccgtccatgccgagcccccgactgcagcattcaaagcccccacggaggttgagccgggcacagaaacacagcagcgggagcagcaacaccagcactgccaacagatctacacacaatgagctggaaaagaatcgacgagctcatctgcgcctttgtttagaacgcttaaaagttctgattccactaggaccagactgcacccggcacacaacacttggtttgctcaacaaagccaaagcacacatcaagaaacttgaagaagctgaaagaaaaagccagcaccagctcgagaatttggaacgagaacagagatttttaaagtggcgactggaacagctgcagggtcctcaggagatggaacgaatacgaatggacagcattggatcaactatttcttcagatcgttctgattcagagcgagaggagattgaagtggatgttgaaagcacagagttctcccatggagaagtggacaatataagtaccaccagcatcagtgacattgatgaccacagcagcctgccgagtattgggagtgacgagggttactccagtgccagtgtcaaactttcattcacttcatagaacccagcatgacataacagtgcagggcaaaatattcactgggccaattcaatacaaacaatctcttaaattgggttcatgatgcagtctcctctttaaaacaaaacaaaacaaaacaaaactatacttgaacaaaagggtcagaggacctgtatttaagcaaatacttagcaaaaagtggggcagagcctcccaaggagaacaaatattcagaatattcatattggaaaaatcacaatttttaatggcagcagaaaacttgtgtgaaattttcttgatttgagttgattgagaagaggacattggagatgccatcctctttctcttttctagtttgctcatactacattgagtagacacatttaaggatggggttatgaacccttcctgagctttatggtcctaaaagcaaaataaaaactattcgaatgaaaagacaagaaaatcaggtattaatcttggatagctaataatgagctattaaaactcagcctgggacagtttatcatgaagcctgtggatgatcaatcctttattattattttttttttttgaaaaaagctcatttcatgctctgcaaaaggagagactcccatgaagccttttgaaagggatcatcatgcagctcaactttctgttggattccatgctaagcaagctaaccttatcctgcattgttagcactaggcacccagctgccacctctccatcctgctgcccttaggccacatgggagcagtccatgcatgacagcctctatcctacaaggcctatgagtatggattgggggggccaaaaggaaaaagctccatgtgcctctttgtctgcgtgggtcagaagagttgtgcacgcagattagcaggccaaggtctgagccacagcagcatttttatttcagattttgataactgtttatatgtgttgaaaaccaaaatgacatctttttaaagcttatccataaaaaaaaatagatgtcttttatagtggaaaaacacatggggaaaaaaatcatctattttgatgcagcatttgataatgataaaacacctcacacctcactctttatagtgcacaaaatgaatgaggtctgggctaggtagaaaaagggtcaatgctatttttgtttttagaatcattaccttttaccagcttttaaccatctgatatctatagtagacacactatcatagttaacatagtaagttcagcacttgtctcattttaatgtaaagatttgcttccattttcctacaggcagtctctctcttcctcacagtcccactgtgcaggtgctattgttactcttacgaatattttcagtaatgttattttcttctaagtgaaatttctagcctgcactttgatgtcatgtgttccctttgtctttcaaactccaaggttcccttgtggccctctcccttaccctgggaaggcctcttggagaccttacccctggctgtttggactttgtatactttaaataatttaactacccttaattacttaaaaaaaaaaaaaagctttatgattttcataacttattgctgattttaatggattgttaatttcagtcctgtagttttattttatgtttagatagggctgggcaaggaaaaagaaaataaagacaaccatatttagcagtgcagttgagttgtgtgttaatgttagactatccctttgtgagtgacactttaacagcattcactgcttctatatatagtgtaccatcttggtcatacattacgcctcaacatatacttgtgctcttcctttgcctccagaagaagtttttccttgattgtgctatgtttcagtggaagaaattctttgaagtagatgtgagtgaaaaactgcatgcctttagaagcccagtatcagaacttgctacgtttcaggtgctagggacttaatgaaaaacaggacaaaacaattcctttttgtggcccaggtaaattatttctggtttcacttataattactaatggctgagtcaagatgttgtctctgtgtttgcttactcttgatcaagtgtgagacagtttgaagactgtgctaccatacaaagtgaatgaagccagtgactaagcttctgtttgttttgttattctcatggccttcgcttgcattatttgggccttcattcagatgaacttgaggtgccattttgttgcatatgtacaggattatgggctggaaagcatttgttataaacctatagtgcacattttaactgccccctaaattacccttccctgggtttgttttccttggggtggtgtagattgtatgagtaagaagtattaattttttaaaagacaaatcaactttgaagacacaaaagttaattggaagaaataaaaactgtgaacgaagaa

SEQ ID NO: 5636 - DNA, 8999 bp, Homo sapiens
cggacggcggcgggagcgcgcgagaagctctaggacccagcagcggttgtcgggtttggggctggaggtgaagccctgtgtgaatggggttgattgtccggcgccacttccccgcgctgcccggcagccgtcttccccagccgagggactgaactagccatgatcgcctcatgtggagggcaaagttgcgccggggaacttgtgagcctgcggtgaaagggtccccttctgcttgttatagccccagtagtcctgtccaggttctagaagactccacctacttttccccagactttcagctctattctgggaggcatgaaacatctgctttgacggtggaggcaaccagtagcatcagggaaaaagttgttgaagatcctctttgtaacttccactccccaaacttcctgaggatctcagaggtggaaatgagaggttccgaggatgcggcagctggaacagtattgcagcggctgatccaggaacaactgcggtatggcaccccaaccgagaacatgaacttgctggccattcagcaccaggccacagggagtgcaggaccagcccatcctacaaacaacttttcttccacggaaaacctcactcaagaagacccacaaatggtctaccagtcagcacgccaagaaccgcagggtcaagaacaccaggtggacaatacggtgatggagaaacaggtccggtccacgcagcctcagcagaacaacgaggaactgcccacttacgaggaggccaaagcacagtcgcagttcttcagggggcagcagcagcagcaacagcagcagggggcggtgggccatggttactacatggcagggggcaccagtcagaagtcccgaactgaggggaggcccactgtgaaccgtgccaacagtggacaggcgcataaggacgaggcgctgaaggaactgaagcagggccacgtccgctcgctcagcgagagaatcatgcagctgtccctggagaggaatggggccaagcaacaccttcccggctcggggaatggaaagggcttcaaagtaggaggggggccctcccctgcccagcctgcaggtaaagtgctggaccctcggggtcctccacctgagtaccccttcaagaccaagcaaatgatgtccccagtcagcaagacccaggagcacggacttttttatggtgaccagcaccccgggatgctccacgagatggtcaagccctaccctgctcctcagcctgtgagaacagatgtggccgtcctgcggtaccagccaccccctgagtatggggtaacgagccgcccatgccaacttccgttcccatcaaccatgcagcagcacagccccatgtcctcccagacctcttccgccagcgggccactgcactctgtctccctgccgcttccactcccgatggccctgggtgctccacagcccccgcctgccgcctcccccagccagcagcttggtccagatgcctttgcgattgtggagcgagcccagcaaatggtggagatattaacagaggagaaccgggtgcttcaccaggaacttcagggttactacgacaatgccgacaagctccacaagtttgaaaaagaacttcagagaatttcggaagcctatgaaagtctggtcaagtctaccaccaagcgagaatcgctggacaaggccatgagaaacaaattggaaggcgagattagaagacttcatgatttcaacagagacctccgagatcgactagagactgctaacaggcaactatccagcagggaatacgaagggcatgaagacaaagctgcagaggggcattatgcttcccagaacaaagaattcttgaaggaaaaggagaaattagaaatggagttagcagcagtgcggactgcaagtgaggaccatcggagacacatcgagatcctggaccaggctttgagcaacgcccaggccagggtcatcaagctggaagaggagttacgagagaagcaagcatatgttgagaaagttgagaagctgcagcaggccctgacccagctgcagtctgcatgtgagaagcgagaacagatggagcggagactgcggacttggctggagagagagctggatgcactgagaacccagcagaaacatggaaatggccagccagccaacatgccggaatacaatgccccagccctcctggaacttgtgcgggagaaggaggagcggatcctggccctggaggccgacatgacaaagtgggagcagaagtacctggaggagagcaccatccgacactttgccatgaatgccgcagccactgcagcagctgagagggacaccacgatcatcaaccactcacggaatggcagctacggagagagctcgctggaggcccacatctggcaagaggaggaggaggtggtgcaggccaacagaaggtgtcaggacatggaatacactattaaaaatctccatgccaaaatcatagagaaagatgctatgattaaggtcctgcagcagcgatctcgtaaagatgccgggaagacagactcctccagcctacgtcctgcccgctccgttccatccatagcagcagctactgggacacactctcgccagacctctcttaccagcagccagctggctgaggaaaagaaggaagagaagacctggaaggggagcataggattgctgctggggaaggagcaccatgagcatgcctctgccccactgctgccacccccacccacctcagcactgtcctccatagcctccactacggcagccagcagtgcccacgccaagacaggcagcaaggacagcagcacacagactgacaagagtgccgagctcttctggcccagcatggcctcccttcccagccgcggccggctgagcacgacccctgctcacagccccgtcctgaaacacccagcggccaaagggaccgcagagaaactggagaactctcctggccatgggaagtcgcctgaccacagaggccgggtcagcagcttgctgcacaagcccgagttccctgatggagagatgatggaagtcctcatctaactgccatccctgtggaatttcagtacagaacactgacaaacaaggaaagcggcagagaaagaagaaagacctagaaggttgtagatgggaaatcaggaatgatttgaactgataaagatttcagactcataagaacacattttataaatgttaaacacaaaaactacatgactgaagatagaagagaatgcgatggattttattacacatggtggaagagagaagaggcgtgtaggtttgcaaacaaagttaagaaataggaaactgaatttttcattgtacagaaaatgtatctcttggggagggcctgtgtacccccattctctgattataaacagataaacccaaatgtggatcatccttggaatacccccattctccttgcctcttagcatgtttgatttaagaaaagcctccaggaaatcttgagagcctgtcttggcataatgcagtgtcacctgtgccaaccatggggtgtcccgtgagtgtgagtgtggcagtgagaagaagcatcgagggcgaggggaatatgaaagttggtcttcacctaattacctgtttggtttggattttcaagagatgattgggcttcttagcttttctgaattctgcagtattttctaaacaggatagattatgatctcggtccccatccatcctaacttctgagttcatctctgtctctgctttacagtctttaattttttgttgttccttcatttttttctttttaataagacatagcagaattccttaggtatgggatttatgagaccagtacctgaactgtcatcattcctactgtgtttgatagtgaccagtaggacaaagccacgtgccgacttcctggctgcttcacctttgcatagctgggttgcagctgcgaacctcattctgactgtgaactaagcaagctttgaggaggcaggagattccgtgggtccctgtgacatattgcattaagatcgtggcacttgcttttttgtctttcacatcggctgtcttgcaaggagcttgacatttccaaattccattgctctgtttggggaagacttaggacagcactccaggaaacagatgacaatttacagacagttgtctcagtggtttccagaatctcaccagcctcccgtatagcttcttgtattgaggctcatgagcgtattcacactctttcctcccccgcgcacgcctctgcttgctctcgatcagcatccagacctccgtggcaccaggttgcctctgttgtgaacttcttttgtaacctaccaggccagttgtatatacagtgttgtcaggtttttccgggtttcagttttgaggcagtttattcaaagtgagacagaagtgccacggaaaagaggcaggagtgtgttaggtggtgggtccattagacctctgctgtgacattgcatattcagctctgcagacactggcttcctttacaaatctaagagatgctggattagaaaagaggagaagctcatcgggccatcagagagatgctcctacagggtcctgatgtttttgtacctccaggtcagctggatcgctgttttcccagttccctttgctcatgcttacttagaggaagaaagaaaggggggtacctcttccaagtaccttctaaatgaaacactcaagagagtgctactcaggaaactttgcttggatcctaaaatggactggtcttgggtgtgtaaccccggtgaagttatagcctccccaaattgaggtgacagaaggaagacaagaggtgtaagctggagagggaagggaagaaatcagtggctttggccagcctctgtgccacccagtacgacagaggagtgggaactggccctctggggctctgcttggccataggcactgcacattgtgccacctgctcatcacctcctctagtctcacactgagcatcggagtacctgttgtgcagacaggaaaactgaggagctctgagaggctgagcatggagctcaccccatgccatagggtgtgggaagagggcacaggaggcctcatccatgggggaaagggttgaggatggacatgggtggggagagggcatagacatcccttcctaatctctgttcccaccacatttcataggagatgagttaggagatgacagctaactctcttaaggacattttgaccccagtttatgttggggatggaccagaaaggaaaatgtctagagataggaaggtaaatcaactctgccagcccctaccatcaggtctgggccaccccaaacttgggctgcctcccttagacataggttagagtgagagacccagctgtttctcccgaagcctcgtcttcatgccccagacacctgattgccccaatcaggtgtcagacttgcttgctcttcgaggtccccctgagctgccaagtgttttcattgtaaacagacacatcgccatgtttcagggcttcaacggcattgtattttggactttgaccgtattttttttctcttaacctactgagactcttccttaagaacaggatctatagctttaaaatgtcttcttctatgggaaatttcctgccaagccagggcactaaattctttcatcattagagctttcctgaagtccggccatatactgagtacctgctctgagttctgggcagcttacaatatcttaaacagattttcagaaaaataatgcaactatattttctagtgtcaactgtatgcaaacagtgtggtaaataccttttaattagtcctccacccacctggagtacagggggtgcgtttattattctgatttcactgatgaggaaatgggctcagaaaggttaagtcccttcctgaaatctcacagccaggagaagctaggatgatttaaaacaaagtttggagaggcactgggcatagaccctggctgtacagcctctaacatgcggcactgcatcttggcagtctctatgcctgtctgtgatgtgtgtgtgcacgtgtaactacacacacacacacacacacacacacacacacacacagctatcacacatctcagagcctaagaaataggactaagcccagaactcctagaatcacctataaatgctaggcatagatggaaattattgtgttccaccagaagcacagctccaaactatacctaaaaaatatttctgcacttcccagagacctggacttcaaactttcccagtggagcctgattatagaacttgagggtcctatctcaggatgaaggggagaggccctggcttcacgggaaggtattccagcattgttctgcttcacccttgactgcgttgtctggcagtttctgtgtgctgccaggatattatatggaactggagaagttggagtcaggtctctgaagctagagtttcactaattagatgcctctgtacatgagaactattactgtctgcaggtccatatagctaagctgccaggaaaaacacattatcttccaaaactttcagagcatgtgcagaaccctttcttagcgttttcttctcagcattttctctgcctcccagaggctggcagccagtgacactgcagagttcagcatgttctaaccatgcacgcagggcaggggctgccttggccctcctcaggctttcgttgggagagcaggcagtggtggagcccttctgggtgcagtcctctggggttgctctttggaactcatgtatgagtttgactccacaaggcttggcatggataccaaaacagttgcaacaaattagttctgaacctggaacagagaattcagtgcttctgttactcaggaaggaggtgttcagaatgccccgtgcagagcagccagtcattactcttgtttgttctcacctgggtgcgcaccctcatgatgcagtggctgtagcaccttcatgccaggtgctgagagaatgggaaattcttcctccccattgacctgagtcccagagacttagggacacagacttcaggtgaggctgcggacctcagaagcagtggataatagattggggcattaaaagcttttgaggcagggggctcatgttttgactgcagggagttatgctgagcaaagagatgtgtttttcaaaaccagggttcaaaaccagtgtccacgctggagtaagtggagcatgcttctctgtgttctctgaatgatcttgcactcctcttaagcaaaggagtaccatgaccatagtcagtgggatcccacaaatgttcttaaatgggtaaggctttaagtagccagagagtatccagcctaccattggcttctccacatcctaaaacctgagacagccttggtatatgctttataaatgtttcttttcttgttgtttaagtaattaaagtgtttaaaatgtcttcattagatgtgacgattgtttaatgagtttgcctctgacgtgtggctccatgggagataggcaaagtaattaagaagttaccagaaattggtcggctggggaaatgcaaaagttagcatttcagtagtgaatttctcctggaacaaatgagcaatttttcctctttctcttaagtagtatacccttttctcacttagtaatttaatggtatataaagacatgtgtataagtgagtgcatacatatgaggtatgactatagggttgtttgtgggaatttcttttcctaacatacagaagatcaaagtgttcatctcaccccgccctccttaaaaggtgtcttttgggagactatgtgctcattgactatagtgctgccaagtaaaaatatcttgggaactcttctactagaatggccttcagggcttggcatgttcctttggtttacccttagagatgagaaatcctcctcctttgaggatggatttaagttctggaaataatctcaagtgcttgatagcacagttggatgaaaaaagatggcaattaaggtaagttacaccatttttgtttctaaaaaaatccctaagaaatttcttggaatgagtctttggcctcagagcctctcaaagtgtccacttcaaggggggatcatcctcattagcacacagatttttaaaaatcaattctcttgccatgcctcctatgtgttcacatctctgcatacactacagatataagtgcataatcattcatataaacatctggtaggtattctgtaaaactgtgtttactttagtgcatgttattgtcatgttatgatgtgactggggtgtttctttgtcatgaaactttgcttcttcacagaattagaatactgctctctctatattgaactacatatacagcgttttcttgtatcagcccccaaagtctggatgcccggtgttgtgtttacatgtgattgtgcctaggagtctgttcacatagagacacctgtaagtatttattacaaaacggaatgtaagcaaatatatccacattggttttatttgaatcaaggtgtttttttgttttttgttttttttccttttgaggaggaacagggagcctcctcctccatgagcacttacagaattgtgtaaaattctgtgaaacagtggtaagcatgggcacccgatttcagctgtcctgctgccgctgccctccaacctgctctgtgtgtgtgtgtcgctgtgcttggtggcagtgtgccgtgctcgtgccggctcttcccagcagactggtatctggctgtaacgtttgacgtcttcatattgccagtctgtattgaggggtgatgtacatggccatacagccaaatgggtctgtgtaccagtgtggggattccaagaacactgcctgtcccccacagcaaatattgatgctgttggtcagccaaagattttcctctcctttgctgcttaaacttgtgccttaatattgtacataataaatggataaaatggcaaaatgactcttttctctcgcttgctcctttcttccttaaagaacttataaactgatgctcaataaatgtttcatttcattgtacccca

SEQ ID NO: 5637 - DNA, 2362 bp, Homo sapiens
agcgggtttttgacggctggaggccaccgagaagaaggaggaagcaggggtggcggctgctgcggcggttgcggcgggggccggggtgggcgccgcggtccgggccgggcagtgaggcgcgggcggccgggccggtgggctgggcggcgggcccggcggccgccctcgcacccttgcccgcgcctggcggcccgatgtggctgcagcagcggctcaaggggctgccgggactgctgtcgagcagctgggcccgccgcctcctctgcctgcttggcctcctgctgctgcttctgtggtttggggggtccggcgcgcggcgggcggcgggcggcctgcacctgctgccctggtcccgcggtgagccgggcgccgccgagccgtctgcctgcctggaggcggccacccgcgcctggcgcggcctgcgggagcgcggtgaggtggtaccgctgggtcctggagtgccggccctggtggccaacggcttcctggcactggacgtggctgccaatcggctgtgggtgactcccggggagcgggagcccgccgtggcgccggactttgtgcccttcgtgcagctgcgcccgctgagcgcgctggctgaagctggagaggcggtgctgctgctgcgggaggggcttctgcgccgcgtgcgttgcctgcagctggggtccccaggtcctggccccgtggccgccggccccgggcccgcctccgtctctggccttgccgcggggtccggccgcgactgcgtgctgctgcaagaggactttctggcgcacaggggccgaccccacgtctacctgcagcgcatccagctcaacaaccccacggagcgcgtggccgcgctgcagactgtggggcccactgccggcccagcccccaaggccttcaccagtaccctggagaaggtcggagaccatcagttcctcctctactcaggccggtccccgcctacgcccactgggttggtgcacctggtggtggtggccgccaagaagctggtgaaccgcctccaagtggctcccaagacgcagctggatgagacggtgctgtgggtggtgcacgtctctggccccattaacccccaggtgctcaaaagcaaagcagccaaggagctcaaggcgctgcaggacttggcacggaaggaaatgctggagctcttggacatgccagcggcggagctgcttcaagaccaccagctcctctgggctcagctcttcagcccaggagtggaaatgaagaagatcactgacacccacacgccgtctggcctcaccgtgaacctgacgctctattacatgctctcctgctcgccagccccactgctcagcccctccctgagccacagggagcgagaccagatggagtcgacgctcaactatgaagatcactgcttcagcgggcacgccaccatgcacgccgagaacctgtggccggggcggctgtcctccgtccagcagatcctgcagctctctgacctgtggaggctgaccctccagaagcgtggctgcaaggggctggtgaaggtgggtgccccaggcatcctgcaggggatggtgctcagctttggggggctgcagttcacagagaaccacctccagttccaggccgaccccgacgtgctgcacaacagctatgcattgcatggcatccgctacaagaacgaccatatcaacctggccgtgctggcggatgccgagggcaagccctacctacacgtgtccgtggagtcccgtggccagcctgtcaagatctatgcctgcaaggcaggctgcctggacgagccagtggagctgacctcggcgcccacgggccacaccttctcggtcatggtgacacagcccatcacgccactgctctacatctccaccgacctcacacacctgcaggacctgcggcacacgctgcacctcaaggccatcctggcccatgatgagcacatggcccagcaggaccccgggctgcccttcctcttctggttcagcgtggcctccctaatcaccctcttccacctcttcctcttcaagctcatctacaacgagtactgtgggcctggagccaagcccctcttcaggagtaaggaagatcccagtgtctgagtgaactaacagtcctgctttcagccaccatttgcacaagacacccagcactgaaagtcccgctgccaggagcaagggatcctttggaagcacccgccctttgtgccttgttgggggaaaccggtgacgcagaagtgagtgtggatacaccagagtttgcattggaaggaatgagtgtcacgtggggagggaaggggccagtggaccttttgtaagctttccactcaataaaatgaacctgtatggcaaaaaaaaaaaaaaaa

SEQ ID NO: 5638 - DNA, 6255 bp, Homo sapiens
actcgcctggagcgcgcgggcaaggcgggcggagcgcactggaactcaagggggcgcacagcggcgcgctcgcaccgctcggctccgcgcggctctaggaggtggcggcggtggcggtggcggcggtggcggcggcggcggcggcggggcgcagggctgagcgagcgtccgggttccggggctccggggaaggcggttgcagctcctgagtgcagcgcggcttcctgccactgtcccggcccggccacctctctgtcatggctctggcggacagcacacgtggattacccaacgggggcggcggcgggggcggcagtggctcctcgtcgtcctccgcggagccaccgctcttccccgacatcgtggagctgaacgtggggggccaggtgtacgtgacccggcgctgcacggtggtgtcggtgcccgactcgctgctctggcgcatgttcacgcagcagcagccgcaggagctggcccgggacagcaaaggccgcttctttctggaccgggacggcttcctcttccgctacatcctggattacctgcgggacttgcagctcgtgctgcccgactacttccccgagcgcagccggctgcagcgcgaggccgagtacttcgagctgccagagctcgtgcgccgcctcggggcgccccagcagcccggcccggggccgccgccctcgcggcgcggggtgcacaaggagggctcgctgggtgacgagctgctgccgcttggctactcggagcccgaacagcaggagggcgcctctgccggggcgccgtcgcccacgctggagctggctagccgcagtccgtccgggggcgcggcgggcccgctgctcacgccgtcccagtcgctggacggcagccggcgctcgggctacatcaccatcggctaccgcggctcctacaccatcgggcgggacgcgcaggcggacgccaagttccggcgagtggcgcgcatcaccgtttgcggaaagacgtcgctggccaaggaggtgtttggggacaccctgaacgaaagccgggaccccgaccgtcccccggagcgctacacctcgcgctattacctcaagttcaacttcctggagcaggccttcgacaagctgtccgagtcgggcttccacatggtggcgtgcagctccacgggcacctgcgcctttgccagcagcaccgaccagagcgaggacaagatctggaccagctacaccgagtacgtcttctgcagggagtgagctccccagaccccctcgccactccagcgcccagtccttctcctgcccgagagatgattacagagcctcttgtcccacctttgtcccctggctgctgccctcccattctccccctccagtagtagctgggtgagacctgtccgcccaccttccctccactacagaacctgcagccgcaaatcctctgggctgcttcgtcttctttggacctcctgaaccgagagaacccagaggaacccccaccccacccccacctaccactccatgctttctctactccctgcctcaaaccacccctcccccagatggtacttcagtttggatctattgggggagtgtggccacagaccgggggatgattgaattgttcagaacctgattggaccgtgtccaatgtgcggaagatttccttgaaatcttctcaagctcttatgactcactgggggtttaagagatcaggattggttccactgtctggggttagtgttttacaaggtcattacacagtctttttgacctcttttgaaggtagagttttagaaggctggatggaagattctgagcctggaattaggaccccatggaggcagttcagtaactaaactaataaagttttgaaaagttacacgtaaagtagaagaatctagtgcgtgggacagtaaaggatcctttctcgtacagaataaaaggtctcagcctgtagcttaaacttatagaaagtgatccgcctgcctgcagaggcgcccttttcagctgctgctcgccagaagcccttgattccactggttgacatggcagcagttactggcaagagggagaaaggacgctgccgcctaagagtgcaaggctgctcaggtctccaagcgccgtaggaggtcacctggcagtgactgtagggagctgggtcatagtgcacgtcgtgggtattaggaaagcctgtattctttcaatgaatgtcagtaggaccttcctttagctgtaagacttggtgggcggggtggggtggggagggaggaaagggtaggaagggtgggaagggagaagcagacatagtcatttatgatttgaaagttggaagtttgtaccatctgtttgagtatatgcacatttaaaaaatatcatatagtaaatgcaaacatgccaagtattttataaagattaataacagacctactcttacctggcagtttacttaacttactgttttgagtcctaaacttagagttgttaatgcttatatataatctaaccaaagagttacccagtagggttttagtttttgaacttttattttcttgttgattataaatcctgattttggaatctattgcgcaaaagaagtttcattttggttacttagacctaagatcacttattaaaaatccttattttctccaagcccagcaaacgttgacttctgggcaaacctgaaaacctgaaaatgccactttcatgcagtttgtttgaagttaagtggaatcctttcaaatgacgagctgcagagaactcagcaccaagggctgcctatctgtagatagctgtaaaatggaatatttttaaatgaaggcaaataagtacttaaaagtgagctgagcaataaaatggtccaataataggtaaatgcaacagaaacagaaggagacctggttgccttatgcctttactcttacatggaataaattcccaatgcatatcctatgtaaaccataagtgaagggaaataaacctcgtcatgctccatgctgtgaggtgtcctttggatattctgtgatgacagagaagcctattttgttttgttttcagcatctttctctgatgtacgtttttaaggattttgtaagagctgttttcagtgtttaaattagtgctatttttccttgtttttaaaaatgaatctcgtactgtatcttactatgtccatacagatgttacaaatcgacagttttattcttagactcatgtgatccaagctgtatataccatatataaacattttacatgaatcatttagttttttaattcatttactaatgctataaaatttcctatattaccccagtaatttgcatcagctggtttatatactaaagcaacatgttttgatgagtttcttacatccttatcgaggaattgggttaggaaaaaatacataattgtaaaactgagtttgctgtattatactttttttcttgagtattagttgtattactaatcatatgttgattaactgtctacttaaagtcaaggtacctgtatttttaatccactaatttttttttagttgggaaatagatttcaggtcttttattagactaacattttttgagaagtaaaattgacttcatatacaaagcctgtaattttaggcgaaatggaagcagaaatctaggaagttgtgcttgcttgtatgttgagtttggtctcagactaagtaatgcatcagaattcatctgtttgaagcctgaaataatttaggactctgattcactgaccaaaagtcagtgttgcagagatttctctaccccgtatggtattttgttagattgttcaacaggaagcacatgattgagaacatcttgggacagaccaaaaccactgacagatggcaaggctcggcgattctgatttcccttctcaaatctgctcaactccaagagtcttgagaaactgctaaaattttgcctctgtcactcaagtcttacaaatgttatcttgtaaacctttgaggtgaactattccactgtcttgtacataggcatcttattcactgcaccctgtcacacccagcaccccccgccccgcacattatttgaaagactgggaatttaatggttagggacagtaaatctacttctttttccagggacgactgtcccctctaaagttaaagtcaatacaagaaaactgtctatttttagcctaaagtaaaggctgtgaagaaaattcattttacattgggtagacagtaaaaaacaagtaaaataacttgacatgagcacctttagatcccttcccctccatgggctttgggccacagaatgaacctttgaggcctgtaaagtggattgtaatttcctataagctgtaatagtggaggtattgtgggttcatttgagtaagccctccaaagataccattcaaataacctgggagaatgtcataaattattcagataattaacactgcatgaatctgattcagaggcatgcatttacatatgttgccctaattaccatttgatgatcataaatacaagtgaatgacattggacttttagtaacaaacttaatttttaaaaaggtgtagacaatggtggttaaaaaaaaaaaaaaaacaggtaccaggttctgtgtgtttgcaccaagtaattgacatgttttttaatacatgtggaccatgaacagtattcattctactttttcaaatgatatgctgtagaaaatattccttgaagatgtgagatttaaaaatttttccctttcaatgttgttatgtattctactggtttttgattgatagcacagtgataaatcataatactagacaaaattgtcttctctttcaaaccagagccatatatatgtctgtatatatgggacctactgcttctctgaggaaatgcataatctgttaatatcagacaaaatgagcaattggcagtgctcataatatattccaatttttattggaattttcgatggaatgttatttcaataaagccatgtaaggtgaaactttgataactttttactcttcaagttagggtaaattctgatccaatattcaattcatttgtgtactcccacatgcaaaatgctaaattacaatgcagacattaagaaaaagtattgactggaggggttgaattccttgagaatttattttatagtctaaatcacaaatactttactcaatttagtttttaaaatagtaaactgaatatttttgttgtaagcctatcagagtcaatccttcgtttggaattgttttcctgtttttccttactataaatcatttaaaaactgaattcattttcttagatggcataagtctgtctcttgagaaataagtaaaatactcctattttcagtatctgtagcacctgaaataggtctttgtatagccagaaacaagttatgttgaagttagcttttctttgtcaacagttttggacaataaaaatctgaaagtattaacacttgattttctactggggcccttcaaacttggttggaagaaattcaaccagaatatctacattagagtataatcatgtgtggtaggaagatggactagttaatcaagatttgttgtcacttaaattttttgtgatttttttccaagccagtttttttaaattctaaatgtgttttgaggtatgggtacattaattgtaatgtaaactattatacaactgtttttgcgactttataggcaggtaaattttgctattactattgaatacaaatgacaattcatttatgaccactcaaacagcgttagtaaccatttagtgacaaaggattaaaacatccatctggatgttaattttgaagatgtaaattatatgttgtttaaatttttccaggcatctgaaaaccttatctgctagacaatgtaagattcacacagagttatctgggattctgattttttaaatagtacatatcattaaaccattttctctaaatgtaagaagagcagaaaaaatcttataagattatcagatttttctaatgacacagaaatgtaagaaaaaaatccctttatattgaaaaaagatgcagtcaaagtcttttcagacatgcccaaactttgagaatttcttcaaccatctaatgctataaagatttttgttcttcctgttcacaaccagttgtataacagaaatactagctactgttttccttcctgtgtgtgaagtaatgaatcattgattatgtgacttgttatgtattcaattaaacactaaagaataaaacattcactcctttaattattcaaaaaaaaaaaaaaaaaa

SEQ ID NO: 5639 - DNA, 1236 bp, Homo sapiens
ctgcggcggcctcggagcgcggcggagccagacgctgaccacgttcctctcctcggtctcctccgcctccagctccgcgctgcccggcagccgggagccatgcgaccccagggccccgccgcctccccgcagcggctccgcggcctcctgctgctcctgctgctgcagctgcccgcgccgtcgagcgcctctgagatccccaaggggaagcaaaaggcgcagctccggcagagggaggtggtggacctgtataatggaatgtgcttacaagggccagcaggagtgcctggtcgagacgggagccctggggccaatggcattccgggtacacctgggatcccaggtcgggatggattcaaaggagaaaagggggaatgtctgagggaaagctttgaggagtcctggacacccaactacaagcagtgttcatggagttcattgaattatggcatagatcttgggaaaattgcggagtgtacatttacaaagatgcgttcaaatagtgctctaagagttttgttcagtggctcacttcggctaaaatgcagaaatgcatgctgtcagcgttggtatttcacattcaatggagctgaatgttcaggacctcttcccattgaagctataatttatttggaccaaggaagccctgaaatgaattcaacaattaatattcatcgcacttcttctgtggaaggactttgtgaaggaattggtgctggattagtggatgttgctatctgggttggcacttgttcagattacccaaaaggagatgcttctactggatggaattcagtttctcgcatcattattgaagaactaccaaaataaatgctttaattttcatttgctacctctttttttattatgccttggaatggttcacttaaatgacattttaaataagtttatgtatacatctgaatgaaaagcaaagctaaatatgtttacagaccaaagtgtgatttcacactgtttttaaatctagcattattcattttgcttcaatcaaaagtggtttcaatattttttttagttggttagaatactttcttcatagtcacattctctcaacctataatttggaatattgttgtggtcttttgttttttctcttagtatagcatttttaaaaaaatataaaagctaccaatctttgtacaatttgtaaatgttaagaattttttttatatctgttaaataaaaattatttccaacaaaaaaaaaaaaaaaaaa

SEQ ID NO: 5640 - DNA, 3636 bp, Homo sapiens
gcagagcaccgcgccttagccgcgaagttctagttcttgctgccggtcctaacgtcccgcagtcttcgccagccagccgtcccgcatgcgcgtttgggcggcgtggagcctgctgccatgaagtcagcgagagctaagacaccccggaaacctaccgtgaaaaaagggtcccaaacgaaccttaaagacccagttggggtatactgtagggtgcgcccactgggctttcctgatcaagagtgttgcatagaagtgatcaataatacaactgttcagcttcatactcctgagggctacagactcaaccgaaatggagactataaggagactcagtattcatttaaacaagtatttggcactcacaccacccagaaggaactctttgatgttgtggctaatcccttggtcaatgacctcattcatggcaaaaatggtcttctttttacatatggtgtgacgggaagtggaaaaactcacacaatgactggttctccaggggaaggagggctgcttcctcgttgtttggacatgatctttaacagtatagggtcatttcaagctaaacgatatgttttcaaatctaatgataggaatagtatggatatacagtgtgaggttgatgccttattagaacgtcagaaaagagaagctatgcccaatccaaagacttcttctagcaaacgacaagtagatccagagtttgcagatatgataactgtacaagaattctgcaaagcagaagaggttgatgaagatagtgtctatggtgtatttgtctcttatattgaaatatataataattacatatatgatctattggaagaggtgccgtttgatcccataaaacccaaacctccacaatctaaattgcttcgtgaagataagaaccataacatgtatgttgcaggatgtacagaagttgaagtgaaatctactgaggaggcttttgaagttttctggagaggccagaaaaagagacgtattgctaatacccatttgaatcgtgagtccagccgttcccatagcgtgttcaacattaaattagttcaggctcccttggatgcagatggagacaatgtcttacaggaaaaagaacaaatcactataagtcagttgtccttggtagatcttgctggaagtgaaagaactaaccggaccagagcagaagggaacagattacgtgaagctggtaatattaatcagtcactaatgacgctaagaacatgtatggatgtcctaagagagaaccaaatgtatggaactaacaagatggttccatatcgagattcaaagttaacccatctgttcaagaactactttgatggggaaggaaaagtgcggatgatcgtgtgtgtgaaccccaaggctgaagattatgaagaaaacttgcaagtcatgagatttgcggaagtgactcaagaagttgaagtagcaagacctgtagacaaggcaatatgtggtttaacgcctgggaggagatacagaaaccagcctcgaggtccagttggaaatgaaccattggttactgacgtggttttgcagagttttccacctttgccgtcatgcgaaattttggatatcaacgatgagcagacacttccaaggctgattgaagccttagagaaacgacataacttacgacaaatgatgattgatgagtttaacaaacaatctaatgcttttaaagctttgttacaagaatttgacaatgctgttttaagtaaagaaaaccacatgcaagggaaactaaatgaaaaggagaagatgatctcaggacagaaattggaaatagaacgactggaaaagaaaaacaaaactttagaatataagattgagattttagagaaaacaactactatctatgaggaagataaacgcaatttgcaacaggaacttgaaactcagaaccagaaacttcagcgacagttttctgacaaacgcagattagaagccaggttgcaaggcatggtgacagaaacgacaatgaagtgggagaaagaatgtgagcgtagagtggcagccaaacagctggagatgcagaataaactctgggttaaagatgaaaagctgaaacaactgaaggctattgttactgaacctaaaactgagaagccagagagaccctctcgggagcgagatcgagaaaaagttactcaaagatctgtttctccatcacctgtgcctctttctagtaactatattgctcagatttccaacggccagcaactcatgagccagccacagctacataggcgctctaactcttgcagcagcatttctgtagcttcctgtatttcggaatgggagcagaaaattcctacgtacaacacacctctcaaagtcacatctattgcaaggcgtaggcagcaggagccaggacaaagcaaaacttgtatcgtgtcagacagaaggcgagggatgtactggactgaaggcagggaggtggttcctacattcagaaatgagatagaaatagaagaggatcattgcggcaggttactctttcaacctgatcagaacgcaccaccaattcgtctccgacacagacgatcacgctctgcaggagacagatgggtagatcataagcccgcctctaacatgcaaactgaaacagtcatgcagccacatgtccctcatgccatcacagtatctgttgcaaatgaaaaggcactagctaagtgtgagaagtacatgctgacccaccaggaactagcctccgatggggagattgaaactaaactaattaagggtgatatttataaaacaaggggtggtggacaatctgttcagtttactgatattgagactttaaagcaagaatcaccaaatggtagtcgaaaacgaagatcttccacagtagcacctgcccaaccagatggtgcagagtctgaatggaccgatgtagaaacaaggtgttctgtggctgtggagatgagagcaggatcccagctgggacctggatatcagcatcacgcacaacccaagcgcaaaaagccatgaactgacagtcccagtactgaaagaacattttcatttgtgtggatgatttctcgaaagccatgccagaagcagtcttccaggtcatcttgtagaactccagctttgttgaaaatcacggacctcagctacatcatacactgacccagagcaaagctttccctatggttccaaagacaactagtattcaacaaaccttgtatagtatatgttttgccatatttaatattaatagcagaggaagactccttttttcatcactgtatgaattttttataatgtttttttaaaatatatttcatgtatacttataaactaattcacacaagtgtttgtcttagatgattaaggaagactatatctagatcatgtctgattttttattgtgacttctccagccctggtctgaatttcttaaggttttataaacaaatgctgctatttattagctgcaagaatgcactttagaactatttgacaattcagactttcaaaataaagatgtaaatgactggccaataataaccattttaggaaggtgttttgaattctgtatgtatatattcactttctgacatttagatatgccaaaagaattaaaatcaaaagcactaagaaataaaaaaaaaaaaaaaaaaa

SEQ ID NO: 5641 - DNA, 1519 bp, Homo sapiens
ggtcacagactgcggagtgggtcaggggctgcgagggctgccccaagtcctaccgggtttgcacgggcgcgcccggctccgcccgcaagtgcgccttcctgacttactgctgggtgcgcggggctgggggtgcgagtaccacccctgaagtctcttcctgggcgacctccggggcctcattctaggcctccttaaagagaaggatctaaattaggaaaaggaagtgcccttatccacgaccaagctcttccacctgcggagctcgcttagtctgcacctcaaccgtgcggaaagtgactgccctgtttactgaggaaaaactggggctcagaaagataccatggagtagtttgaaacaggaacaaaatcttctgaaagctcggagcagaagcctttttggtcaacatggaggaaaaaagacggcgagcccgagttcagggagcctgggctgcccctgttaaaagccaggccattgctcagccagctaccactgctaagagccatctccaccagaagcctggccagacctggaagaacaaagagcatcatctctctgacagagagtttgtgttcaaagaacctcagcaggtagtacgtagagctcctgagccacgagtgattgacagagagggtgtgtatgaaatcagcctgtcacccacaggtgtatctagggtctgtttgtatcctggctttgttgacgtgaaagaagctgactggatattggaacagctttgtcaagatgttccctggaaacagaggaccggcatcagagaggatataacttatcagcaaccaagacttacagcatggtatggagaacttccttacacttattcaagaatcactatggaaccaaatcctcactggcaccctgtgctgcgcacactaaagaaccgcattgaagagaacactggccacaccttcaactccttactctgcaatctttatcgcaatgagaaggacagcgtggactggcacagtgatgatgaaccctcactagggaggtgccccattattgcttcactaagttttggtgccacacgcacatttgagatgagaaagaagccaccaccagaagagaatggagactacacatatgtggaaagagtgaagatacccttggatcatgggaccttgttaatcatggaaggagcgacacaagctgactggcagcatcgagtgcccaaagaataccactctagagaaccgagagtgaacctgacctttcggacagtctatccagaccctcgaggggcaccctggtgacgtcagagctttgagagagaagcttcactgaaacggagcaaaccttccactgagaagccacttcaagaggctggtgctgctagatctcatgatgtggctgttgggaagatggtggggtttgtttgccagcttggagtcctattaaatgaaagccagcaactcatgttggtaataggtctactgtgggaacagttatccctaaccacagctcaaaatcgctatcatctttaggcaaattaaaatctatgtggca

SEQ ID NO: 5642 - DNA, 1911 bp, Homo sapiens
gctcggcctctccccggcacgttctcagctgctcctggttcagacccagcgagggagccgcgagcgaggctcaccgtccccggcgtgcaggatccggggctgctgagcgctcgctcccgcgtgtccggcgcttggagtccccgcggcaggagaggagtcgggacactagagctccaggggcgcctgtgggctccagggcctccggcttccccagtccccttcagctaaagccccagagacgtgctcagccccaggacctctgcggaacaagatccggattgagaagccactgcaactaccgaaatgggcagcaaaaccttgccggcgccggtgcctatccacccttccctgcagctcaccaactactccttccttcaggcagtgaacggcctgcccacagtgccttcggaccatctgcccaacctgtatggtttcagcgcgttgcacgctgtgcacctgcatcagtggacgctgggctacccggccatgcacttgccgcgctcttctttctccaaagtgccgggcacggtgtccagcttggtggatgcgcgcttccagctgcccgcctttccctggttccctcatgtcattcaacccaagcccgagatcaccgctggaggcagcgttccagcgctcaagaccaagccgcgctttgattttgccaacctggccttggcagcaacgcaagaagatccggccaagctcggtcgcggggagggcccaggctcccctgcaggtgggctgggtgccctcctcgacgtgaccaagctgtctccagaaaagaagcccacaaggggacgtctgccttccaagaccaagaaggaattcgtctgcaagttctgtggccgccacttcaccaagtcctacaacctacttatccatgagcggacgcacaccgacgagcggccctacacctgtgacatctgccacaaagccttccggaggcaagaccacctgcgagaccacagatatattcactccaaagagaagcccttcaagtgtcaagagtgtgggaaaggattctgccagtccaggactctcgctgtccacaagacgctacactcacaggtgaaggagctcaaaacctccaagatcaaatgctaaatagaacctgtgggtcacaaggaccctaggcccagcggccctctcctccatagggaccagaagcctgactctggcgggcagcgggagaggcgctcgctcgggaccttccacctctccaacattgtcccctgggtccctggcgcacgcggcacttcagagccccgcccggggccgcgaccccgaccgtccctgctgctcccctaggacgcggctaaactcttggccaaaaggcggtactcacgtggcggaagggaaactgcattaaaaaaagaacgaaagctccgcggagccgcagcggcgcctctcccagaagtattactttttctattgttattttatacgttttcttttttatttttgtctttgaccatataagcttgtaactctgactgcggagagtgagtggagagaggagaggcaacgaagtccttagcactggcagctcccacctcctcctcccgcccctgcccccacccccggagcctgcaaaagtgtaatccctgtatctgcttcagcctcctgccctagggaccgcggggcagccccctcccagctcttgcagctcagctggcggccgtgggctccgggactaggagagcgggacggggacctcgggcctggggtctgcagggggcccggcctccgctgccgcgacactgcgagggagcagccagccaagagccgggcgttatattgcgattggcactttatgctgaccatcggtaacggacatttatcactggagttttttttttttttaactattaaataaacggttattttacaggcaaaaaaaaaaaaaaaaaa

SEQ ID NO: 5643 - DNA, 7355 bp, Homo sapiens
agtctgcgggcctccggggcagcggcgaggccggagcgtcgcggcggagaggacgagaccgggacaagaccagggcaggagggagccggccagccgcgagaaccccgcacgcccggcaagatgctgtcctggcggctgcagacgggccccgagaaggccgagctccaggagctcaacgcccggctctatgactacgtgtgtcgggtgcgggagctggagcgcgaaaacctactcctggaggaggagctgcgcggccggcgcgggcgagagggcctgtgggccgaggggcaggcccgctgcgccgaggaggcgcgcagcttgcggcagcagctggacgagctgagctgggccactgcgctggcggagggcgagcgggacgctctgcggcgcgagctgcgggagctgcagcgcctggatgcggaggagcgcgccgcccgcggccgcctggacgccgagctgggtgcgcagcagcgcgagctgcaggaggcgctgggcgcgcgcgccgccctcgaggcgctgctgggccggctgcaggccgagcgccgaggcctcgacgcggcccacgaacgcgacgtgagggagctgcgcgcgcgcgccgccagccttaccatgcatttccgcgcccgcgccaccggccccgccgcgccgccgccacgcctgcgggaggtgcacgacagctacgcactgctggtggccgagtcgtggcgggagacggtgcagctgtacgaggacgaggtgcgcgagctggaggaggcgctgcggcgcggccaggagagcagactccaggcggaggaagagacgcggctgtgcgcgcaggaggcagaggcgctgcggcgcgaggcgctcgggttggagcagctgcgcgcgcggctggaggacgcgctgctgcggatgcgcgaggagtacgggatacaggccgaggagcggcagagagtgattgactgcctggaggatgagaaggcaaccctcaccttggccatggctgactggctgcgggactatcaggacctcctgcaggtgaagaccggcctcagtctggaggtggcgacctaccgggccttattggaaggagaaagtaatccagagatagtgatctgggctgagcacgttgaaaacatgccgtcagaattcagaaacaaatcctatcactataccgactcactactacagagggaaaatgaaaggaatctattttcaaggcagaaagcacctttggcaagtttcaatcacagctcggcactgtattctaacctgtcagggcaccgtggatctcagacgggcacatctattggaggtgatgccagaagaggcttcttgggctcgggatattcttcctcggccactacccagcaggaaaactcatacggaaaagccgtcagcagtcaaaccaacgtcagaactttctctccaacctatggccttttaagaaatactgaggctcaagtgaaaacattccctgacagaccaaaagccggagatacaagggaggtccccgtttacataggtgaagattccacaattgcccgcgagtcgtaccgggatcgccgagacaaggtggcagcaggtgcttcggaaagcacacggtcaaatgagaggaccgtcattctgggaaagaaaacagaagtgaaagccacgagggagcaagaaagaaacagaccagaaaccatccgaacaaagccagaagagaaaatgttcgattctaaagagaaggcttccgaggagagaaacctaagatgggaagaattgacaaagttagataaggaagcgagacagagagaaagccagcagatgaaggagaaggctaaggagaaggactcaccgaaggagaagagcgtgcgagagagagaggtgccgattagtctagaagtatcccaggacagaagagcagaggtgtccccgaaaggtttgcagacgcctgtgaaggatgctggtggtgggaccggtagagaggcagaagcaagagagctacggttcaggttgggcaccagtgatgccactggttctctgcaaggcgattccatgacagaaaccgtagcagaaaacatcgttaccagtatcctgaagcagttcactcagtctccagagacagaagcatctgctgattcttttccagacacaaaagtcacttacgtggacaggaaagagcttcctggggaaaggaaaacaaagactgaaatagttgtggagtctaaactgactgaggatgttgatgtttccgatgaagctggcctggactaccttttaagcaaggatattaaggaagtggggctgaaaggcaagtcagccgagcagatgataggagacatcatcaacctcggcctgaaagggagggaggggagagcaaaggtcgtcaacgtggagatcgtggaggagcccgtgagttatgtcagcggggagaagccggaggagttttccgtcccattcaaagtggaggaggtcgaagatgtgtcgccaggcccctgggggttggttaaggaggaggaaggttatggagaaagcgatgtcacattctcagttaatcagcatcgaaggaccaagcagcctcaggagaacacgactcacgtggaagaagtgacagaggcaggtgattcagagggcgagcagagttattttgtgtccactccagatgaacaccccggggggcacgacagagatgacggctcggtgtacgggcagatccacatcgaggaggaatccaccatcaggtactcttggcaggatgaaatcgtgcaggggactcgaaggaggacacagaaggacggtgcagtgggcgagaaggttgtgaagcccttggatgtcccagcgccctctctggagggggacctgggttccactcactggaaagaacaagctagaagcggtgaatttcatgccgaacccacagtcattgaaaaagaaattaaaataccccacgaattccacacctccatgaagggcatctcctccaaggagccccggcagcagctggtggaggtcatcgggcagctggaggaaacccttcccgagcgcatgagggaggagctgtccgccctcaccagagaggggcagggtgggccggggagcgtttccgtggatgtcaagaaggtccagggtgctggtggcagttccgtgaccctggttgctgaagtcaacgtctcacaaactgtggatgccgatcggttagacctggaggagctgagcaaagatgaggccagtgagatggagaaggctgtggagtcggtggttcgggagagcctgagcaggcaacgcagcccagcgcctggcagcccagatgaggaaggtggagcggaggccccggctgctggcattcgctttaggcgttgggccacccgggagctgtacatcccttcaggcgagagcgaggttgctggtggggcctctcacagctcgggacagcgcactccccagggcccagtgtcggccactgtggaggtcagcagccccacaggctttgcccagtcacaggtgctggaggatgtgagccaggctgcaaggcacataaaactcggcccctctgaagtctggaggactgagcgaatgtcatatgaaggacccactgcagaagtggtggaggtaagtgcgggaggtgacctaagtcaggcagcgagcccgaccggagccagccggtctgtgaggcatgtcacgctgggtcccggtcaaagtccactgtccagagaagtcatcttcctaggccctgcccctgcctgtccagaggcatggggctcgccagaacctggcccagcagagtcttctgcagatatggacggatcagggaggcacagcacatttggctgcagacaatttcatgctgaaaaggagattatttttcagggccccatttctgctgcagggaaggttggtgattattttgcaacagaagagtcagtgggtacccagacttctgtcaggcaactccagttaggccctaaagaagggttcagtgggcaaatccagttcacagctccactttcagacaaggtggagttgggtgtcataggagattctgtacacatggaagggttgccagggagcagcacatccatcaggcacatcagcattgggcctcagaggcatcagaccacccagcagatagtttaccatgggctggttccccaactgggggaatctggtgactcagagagcactgtgcacggagagggctcagcagatgtgcaccaggccactcacagtcatacctcgggtagacaaaccgttatgactgaaaagagcaccttccaaagtgtcgtttctgaatctccccaggaggatagtgcagaggacacatcaggggcagaaatgacatcgggtgttagcagatcctttaggcacattcgactaggtcctacagaaacggaaacctctgaacacattgccatccgtggacccgtgtccagaacatttgtgcttgctggttcagcggactcccctgagctaggcaagttagcagacagcagcagaacgctaaggcacattgcaccagggcccaaagaaacttcgtttacctttcagatggatgtgagtaacgtagaggcgatccgcagccggacacaggaagcgggagctctcggtgtgtctgaccgtggttcctggagagacgcggacagtaggaatgaccaggcagttggtgtgagctttaaggcctctgctggggaaggagaccaggcccacagagaacagggcaaggagcaggccatgtttgataagaaggtgcagctccagagaatggtagaccaaaggtcggtgatttcagatgaaaagaaagttgccctcctctatctagacaatgaggaggaggagaatgatgggcattggttttaataagcagaaacattttgttttaatggcagcctgttggcgacgtgccaacatccaaaggccttaacttattttaagaggccgagggagtctatgaaaatctccccttttttacttttttaaagagtactcccggcatggtcaatttcctttatagttaatccgtaaaggtttccagttaattcatgccttaaaaggcactgcaattttatttttgagttgggacttttacaaaacacttttttccctggagtcttctctccacttctggagatgaatttctatgttttgcacctggtcacagacatggcttgcatctgtttgaaactacaattaattatagatgtcaaaacattaaccagattaaagtaatatatttaagagtaaattttgcttgcatgtgctaatatgaaataacagactaacattttaggggaaaaataaatacaatttagactctaaaaagtcttttcaaaaagaaatgggaaataggcagactgtttatgttaaaaaaattcttgctaaatgatttcatctttaggaaaaaattacttgccatatagagctaaattcatcttaagacttgaatgaattgctttctatgtacagaactttaaacaatatagtatttatggcgaggacagctgtagtctgttgtgatatttcacattctatttgcacaggttccctggcactggtagggtagatgattattgggaatcgcttacagtaccatttcattttttggcactaggtcattaagtagcacacagtctgaatgcccttttctggagtggccagttcctatcagactgtgcagacttgcgcttctctgcaccttatcccttagcacccaaacatttaatttcactggtgggaggtagaccttgaagacaatgaagagaatgccgatactcagactgcagctggaccggcaagctggctgtgtacaggaaaattggaagcacacagtggactgtgcctcttaaagatgcctttcccaaccctccattcatgggatgcaggtctttctgagctcaagggtgaaagatgaatacaataacaaccatgaacccacctcacggaagctttttttgcactttgaacagaagtcattgcagttggggtgttttgtccagggaaacagtttattaaatagaaggatgttttggggaaggaactggatatctctcctgcagcccagcaccgagatacccaggacgggcctggggggcgagaaaggcccccatgctcatgggccgcggagtgtggacctgtagataggcaccaccgagtttaagatactgggatgagcatgcttcattggattcattttattttacacgtcagtattgttttaaagtttctgtctgtaaagtgtagcatcatatataaaaagagtttcgctagcagcgcattttttttagttcaggctagcttctttcacataatgctgtctcagctgtatttccagtaacacagcatcatcgcactgactgtggcgcactggggaataacagtctgagctagcaccaccctcagccaggctacaacgacagcactggagggtcttccctctcagattcacctggaggccctcagacccccagggtgcacgtctccccaggtcctgggagtggctaccgcaggtagtttctggagagcacgttttcttcattgataagtggaggagaaatgcagcacagctttcaagatactattttaaaaacaccatgaatcagatagggaaagaaagttgattggaatagcaagtttaaacctttgttgtccatctgccaaatgaactagtgattgtcagactggtatggaggtgactgctttgtaaggttttgtcgtttctaatacagacagagatgtgctgattttgttttagctgtaacaggtaatggtttttggatagatgattgactggtgagaatttggtcaaggtgacagcctcctgtctgatgacaggacagactggtggtgaggagtctaagtgggctcagtttgatgtcagtgtctgggctcatgacttgtaaatggaagctgatgtgaacaggtaattaatattatgacccacttctatttactttgggaaatatcttggatcttaattatcatctgcaagtttcaagaagtattctgccaaaagtatttacaagtatggactcatgagctattgttggttgctaaatgtgaatcacgcgggagtgagtgtgcccttcacactgtgacattgtgacattgtgacaagctccatgtcctttaaaatcagtcactctgcacacaagagaaatcaacttcgtggttggatggggccggaacacaaccagtctttttgtatttattgttactgagacaaaacagtactcactgagtgtttttcagtttcctactggtggttttgatattgtttgtttaagatgtatatttagaatgacatcatctaagaagctgattttgctaaactcctgttccctacaatgggaaatgtcacaagaatgtgcaaaaataaaaatctgaggaaaaaacccaca

SEQ ID NO: 5644 - DNA, 1046 bp, Homo sapiens
ggaacaaagagcttataaatacattaggacctggaattcagttgtcgagccaggacggtgacagcgtttaacaaagcttagagaaacctccaggagactgctatcatggcagagaagcccaagctccactacttcaatgcacggggcagaatggagtccacccggtggctcctggctgcagctggagtagagtttgaagagaaatttataaaatctgcagaagatttggacaagttaagaaatgatggatatttgatgttccagcaagtgccaatggttgagattgatgggatgaagctggtgcagaccagagccattctcaactacattgccagcaaatacaacctctatgggaaagacataaaggagagagccctgattgatatgtatatagaaggtatagcagatttgggtgaaatgatcctccttctgcccgtatgtccacctgaggaaaaagatgccaagcttgccttgatcaaagagaaaataaaaaatcgctacttccctgcctttgaaaaagtcttaaagagccatggacaagactaccttgttggcaacaagctgagccgggctgacattcatctggtggaacttctctactacgtcgaggagcttgactccagtcttatctccagcttccctctgctgaaggccctgaaaaccagaatcagcaacctgcccacagtgaagaagtttctacagcctggcagcccaaggaagcctcccatggatgagaaatctttagaagaagcaaggaagattttcaggttttaataacgcagtcatggaggccaagaacttgcaataccaatgttctaaagttttgcaacaataaagtactttacctaagtgttgattgtgcctgttgtgaagctaatgaactctttcaaattatatgctaattaaataatacaactcctattcgctgacttagttaaaattgatttgttttcattaggatctgatgtgaattcagatttccaatcttctcctagccaaccattttcctggaattaaaaattcagtaaaaaaggaaactataaaaa

SEQ ID NO: 5645 - DNA, 816 bp, Homo sapiens
acctttagcctcatttcctgatcgaacagcctcacttgtgttgctgtcagtgccagtagggcaggcaggaatgcagcagagaggactcgccatcgtggccttggctgtctgtgcggccctacatgcctcagaagccatacttcccattgcctccagctgttgcacggaggtttcacatcatatttccagaaggctcctggaaagagtgaatatgtgtcgcatccagagagctgatggggattgtgacttggctgctgtcatccttcatgtcaagcgcagaagaatctgtgtcagcccgcacaaccatactgttaagcagtggatgaaagtgcaagctgccaagaaaaatggtaaaggaaatgtttgccacaggaagaaacaccatggcaagaggaacagtaacagggcacatcaggggaaacacgaaacatacggccataaaactccttattagagagtctacagataaatctacagagacaattcctcaagtggacttggccatgattggttgtaagtttatcatctgaattctccttattgtagacaacagaacaaaacaaaatattggtttttaaaaaatgaacaattgtgcggtatgcaaatgtagccaataatatactcaactggaaaatgaaatgaaaagataatactggctgggtatggtggttcacaccttttatcccagcacttcgggaggctgaggcaggaggatcacttgagaccaggagtttgagaccagcctgggcaacatagcaagacctcatttctacaaacaaaaaaaaaattggcccggcatggtagtacttgcctata

SEQ ID NO: 5646 - DNA, 1808 bp, Homo sapiens
acgcagtgccggcgtcatggcggcctccgcgcacggctctgtctgggggccgttgcggcttggcatccccggcctgtgctgccgccggccgcctctgggtctgtacgcgcgcatgcggcggctgcccgggccggaggtgtctgggcggagcgtggctgcggccagcggaccgggcgcctggggcactgaccactactgcctggagctgctgcggaaacgggattatgaaggttatttatgctccctgctgctccctgcagaatcccgaagctctgtttttgcactgagggcctttaatgtggaactggctcaggttaaagactcagtctctgagaaaacaattggactgatgcgaatgcagttttggaaaaaaactgtggaagatatatactgtgacaatccaccacatcagcctgtggccattgaactatggaaggctgttaaaagacataatctgactaaaagatggcttatgaaaatcgtcgatgaaagagaaaaaaatctggatgacaaagcatatcgtaatatcaaggaactggaaaattatgctgaaaacacacagagctctcttctttacttaacactagaaatattgggtataaaggatcttcatgcagatcatgctgcaagtcatattggaaaagcacaaggcattgtcacttgcttgagagcaacaccatatcatgggagcagaagaaaggtgttccttcccatggatatttgtatgctgcatggtgtttcacaagaggactttctacggaggaaccaagataaaaatgtgagagatgtaatatatgacattgccagtcaagcacacttgcacctaaagcatgctaggtcctttcacaaaactgttcctgtgaaagcatttcctgcttttcttcagacggtttctctagaggactttctaaagaaaattcagcgagtggattttgatatattccacccatctttacagcagaagaatacattacttccattatatttgtatattcagtcatggagaaaaacatattaaaataatttcatggcattgatgttaattctagtctattagttttataaaagttaggattcttatttaggaacaacaggaaatgactgttaaggagaaaatgaatttattgaatgggatgtcaagtagctcacaaaattgagaagttgccgtgggactagggtgccaagactgctgagattctggcagaggcactgccattggcacccctggcccagacagtgtctgctgtgctgtccctggaagctggagctccaacagggaatattggtgtagctgtgcataggccataagccacacttgagccagtgggcagggagaaggaatgtcattctcccttcaccactggggaaggaaaggggaaagggctcaagttatcataggggcttacatgctgagcagctataacctaggtgttcagaacacctggaagatgcatttatttaggggtcacaaatagtgaaattaatatttgaggaatatcagtcacgtgttgtgggcttttatccttaacgtttaatttttacaatcttgtgtaaaaatttatccatgataataacataacttctttaaggttggagtggctggcaagagcagagccttaatttgactttagctctggctggtctggaagcttttacttttttgttaatcccacttcctcactctgtcattcagcattatcatgatcgtgaacaaaattgtactgagaaagtttgtataagtgatatgaacggtattgtattgaacatccattaaagggttgctacactttaaaaaaaaaaaaaaaaaa

SEQ ID NO: 5647 - DNA, 2572 bp, Homo sapiens
gaaatatgaagagacgctgcagctgcggtggcggtggcggccactgcagctcagagcggcgcacgcggcggccggggcgggacgcggggccgggcgcggagaagtcggggcgggcggcagagaggccgggacgcggaccgggccggggcgcccacagccgcccgacggcgcccagagagcgcgcgccccgcagccccgcgcctagcccgccgggcatggggcgcgcggcagccgcctgaagccccggcctggcccggccgcacccggccggaggggagggcagagcgcgcgcccagttgcccgggcaccaaatcggagcgcggcgtgcgggagggcccagagcaggactggaaatgtcctggccgcgccgcctcctgctcagatacctgttcccggccctcctgcttcacgggctgggagagggttctgccctccttcatccagacagcaggtctcatcctaggtccttagagaaaagtgcctggagggcttttaaggagtcacagtgccatcacatgctcaaacatctccacaatggtgcaaggatcacagtgcagatgccacctacaatcgagggccactgggtctccacaggctgtgaagtaaggtcaggcccagagttcatcacaaggtcctacagattctaccacaataacaccttcaaggcctaccaattttattatggcagcaaccggtgcacaaatcccacttatactctcatcatccggggcaagatccgcctccgccaggcctcctggatcatccgagggggcacggaagccgactaccagctgcacaacgtccaggtgatctgccacacagaggcggtggccgagaagctcggccagcaggtgaaccgcacatgcccgggcttcctcgcagacgggggtccctgggtgcaggacgtggcctatgacctctggcgagaggagaacggctgtgagtgcaccaaggccgtgaactttgccatgcatgaacttcagctcatccgggtggagaagcagtaccttcaccacaacctcgaccacctggtcgaggagctcttccttggtgacattcacactgatgccacccagaggatgttctaccggccctccagttaccagccccctctgcagaatgccaagaaccacgaccatgcctgcatcgcctgtcggatcatctatcggtcagacgagcaccaccctcccatcctgcccccaaaggcagacctgaccatcggcctgcacggggagtgggtgagccagcgctgtgaggtgcgccccgaagtcctcttcctcacccgccacttcatcttccatgacaacaacaacacctgggagggccactactaccactactcagacccggtgtgcaagcaccccaccttctccatctacgcccggggccgctacagccgcggcgtcctctcgtccagggtcatgggaggcaccgagttcgtgttcaaagtgaatcacatgaaggtcacccccatggatgcggccacagcctcactgctcaacgtcttcaacgggaatgagtgcggggccgagggctcctggcaggtgggcatccagcaggatgtgacccacaccaatggctgcgtggccctgggcatcaaactacctcacacggagtacgagatcttcaaaatggaacaggatgcccgggggcgctatctgctgttcaacggtcagaggcccagcgacgggtccagcccagacaggccagagaagagagccacgtcctaccagatgcccttggtccagtgtgcctcctcttcgccgagggcagaggacctcgcagaagacagtggaagcagcctgtatggccgggcccctgggaggcacacctggtccctgctgctggctgcacttgcctgccttgtccctctgctgcattggaacatccgcagatagaagttttagaaagttctattttttccaaaccaggattccttactattgacagatttgctttaccaaaagaaaagacatttattcttttgatgcacttgaatgccagagaactgtccttctttttctcctctccctccctcccagcccctgagtcatgaacagcaaggagtgtttgaagtttctgctttgaactccgtccagcctgatccctggcctgagcaacttcacaacagtaattgcactttaagacagcctagagttctggacgagcgtgtttggtagcagggatgaaagctagggcctcttatttttttctcttaattattattatatttctgagttaaacttagaagaaacaactatcaagctacaacttttcctgccattttcctgtggttgcagcctgtcttcctttgaaattgttttactctctgagttttatatgctggaatccaatgcagagttggtttgggactgtgatcaagacaccttttattaataaagaagagacacaggtgtagatatgtatatacaaaaagatgtacggtctggccaaaccaccttcccagcctttatgcaaaaaaaggggagaatcaaagctttcatttcagaaatgttgcgtggaaaagtatctgtaattaaagtttcgaagtaatttaaaaaaaaaaaaaaaa

SEQ ID NO: 5648 - DNA, 1719 bp, Homo sapiens
cacagtcctcggcccaggccaagcaagcttctatctgcacctgctctcaatcctgctctcaccatgagcctccgcctgcagagctcctctgccagctatggaggtggtttcgggggtggctcttgccagctgggaggaggccgtggtgtctctacctgttcaactcggtttgtgtctgggggatcagctgggggctatggaggcggcgtgagctgtggttttggtggaggggctggtagtggctttggaggtggctatggaggtggccttggaggtggctatggaggtggccttggaggtggctttggtgggggttttgctggtggctttgttgactttggtgcttgtgatggcggcctcctcactggcaatgagaagatcaccatgcagaacctcaacgaccgcctggcttcctacctggagaaggtgcgcgccctggaggaggccaacgctgacctggaggtgaagatccgtgactggcacctgaagcagagcccagctagccctgagcgggactacagcccctactacaagaccattgaagagctccgggacaagatcctgaccgccaccattgaaaacaaccgggtcatcctggagattgacaatgccaggctggctgcggacgacttcaggctcaagtatgagaatgagctggccctgcgccagagcgtggaggccgacatcaacggcctgcgccgggtgctggatgagctcactctgtctaagactgacctggagatgcagatcgagagcctgaatgaagagctagcctacatgaagaagaaccatgaagaggagatgaaggaatttagcaaccaggtggtcggccaggtcaacgtggagatggatgccaccccaggcattgacctgacccgcgtgctggcagagatgagggagcagtacgaggccatggcagagaggaaccgccgggatgctgaggaatggttccacgccaagagtgcagagctgaacaaggaggtgtctaccaacactgccatgattcagaccagcaagacagagatcacggagctcaggcgcacgctccaaggcctggagattgagctgcagtcccagctgagcatgaaagcggggctggagaacacggtggcagagacggagtgccgctatgccctgcagctgcagcagatccagggactcatcagcagcatcgaggcccagctgagcgagctccgcagtgagatggagtgccagaaccaagagtacaagatgctgctggacatcaagacacgtctggagcaggagatcgccacctaccgcagcctgctcgagggccaggacgccaagatgattggtttcccttcctcagcaggaagcgtcagcccccgtagcacctctgttaccacgacttctagtgcctctgttaccaccacctctaatgcctctggtcgccgcacttctgatgtccgtaggccttaaatctgcctggcgtcccctccctctgtcttcagcacccagaggaggagagagccggcagttccctgcaggagagaggaggggctgctggacccaaggctcagtccctctgctctcaggaccccctgtcctgactctctcctgatggtgggccctctgtgctcttctcttccggtcggatctctctcctctctgacctggatacgctttggtttctcaacttctctaccccaaagaaaagattattcaataaagtttcctgcctttctgcaaacataaaaa

SEQ ID NO: 5649 - DNA, 3212 bp, Homo sapiens
gtcacatccgggcgggttggtgagttccggtatttcagggcgtagcaggcggaagtaagggtgagaggaggctgcaacgccgagcggaggaggcaggaaccggagcgcgagcagtagctgggtgggcaccatggctgggatcaccaccatcgaggcggtgaagcgcaagatccaggttctgcagcagcaggcagatgatgcagaggagcgagctgagcgcctccagcgagaagttgagggagaaaggcgggcccgggaacaggctgaggctgaggtggcctccttgaaccgtaggatccagctggttgaagaagagctggaccgtgctcaggagcgcctggccactgccctgcaaaagctggaagaagctgaaaaagctgctgatgagagtgagagaggtatgaaggttattgaaaaccgggccttaaaagatgaagaaaagatggaactccaggaaatccaactcaaagaagctaagcacattgcagaagaggcagataggaagtatgaagaggtggctcgtaagttggtgatcattgaaggagacttggaacgcacagaggaacgagctgagctggcagagtcccgttgccgagagatggatgagcagattagactgatggaccagaacctgaagtgtctgagtgctgctgaagaaaagtactctcaaaaagaagataaatatgaggaagaaatcaagattcttactgataaactcaaggaggcagagacccgtgctgagtttgctgagagatcggtagccaagctggaaaagacaattgatgacctggaagataaactgaaatgcaccaaagaggagcacctctgtacacaaaggatgctggaccagaccctgcttgacctgaatgagatgtagaacgccccagtcccaccctgctgctgctcctccctctgacccagactccgcctgaggccagcctgcgggaagctgacctttaactgagggctgatctttaactggaaggctgctttctcctttcaccaccccctccttccctgtgtctttttcgccaaactgtctctgcctcttcccggagaatccagctgggctagaggctgagcacctttggaaacaacatttaagggaatgtgagcacaatgcataatgtctttaaaaagcatgttgtgatgtacacattttgtaattaccttttttgttgttttgtagcaaccatttgtaaaacattccaaataattccacagtcctgaagcagcaatcgaatccctttctcacttttggaaggtgacttttcaccttaatgcatattcccctctccatagaggagaggaaaaggtgtaggcctgccttaccgagagccaaacagagcccagggagactccgctgtgggaaacctcattgttctgtacaaagtactagctaaaccagaaaggtgattccaggaggagttagccaaacaacaacaaaaacaaaaaatgtgctgttcaagttttcagctttaagatatctttggataatgttatttctattttttatttttttcattagaagttaccaaattaagatggtaagacctctgagaccaaaattttgtcccatctctaccccctcacaactgcttacagaatggatcatgtcccccttatgttgaggtgaccacttaattgctttcctgcctccttgaaagaaagaaagaaagaagactgtgtttttgccactgatttagccatgtgaaactcatctcattacccttttctgggtttgaagctgctgtctctagaagtgccatctcaattgtgctttgtatcagtcagtgctggagaaatcttgaatagcttatgtacaaaactttttaaattttatattattttgaaactttgctttgggtttgtggcaccctggccaccccatctggctgtgacagcctctgcagtccgtgggctggcagtttgttgatcttttaagtttccttccctacccagtccccattttctggtaaggtttctaggaggtctgttaggtgtacatcctgcagcttattggcttaaaatgtactctccttttatgtggtctctttggggccgattgggagaaagagaaatcaatagtgcaactgttttgatactgaatattgacaagtgtctttttgaaataaagaaccagtccctccaaccctcagacctatttgacttttatttattaaaactaaatgtgctttctccacagaagctatgaggtttgggttaaaaatagcatctttgtgggtggtagcaacaggatttattctttattattattatttttgagatgaagtttcattcttgttgcctgggctggagcgtaatggctcgatctcggctcactgcaacctccgcctcctggttcaagagattctcctgcctcagcctcccgagtagctgggattacaggcacctgccaccatgcccgggtaattttttatattttaagtagagacagggcttcaccatgttggccaggctggtctcgaactcctgaccttcaggtgatccacctgcctcagcttcccaaaatgctgggattacgggcgtgagccaccgcacccagctggagcaacaggatttaatatagagcaaatgtttagttttatcatctgtaaaatggagataagtattgtcagagtaaacatgaagattagaaagaacacttaatgtgctgggccttttataggttaacactgacatctcaggctgaactatatacattttccttcacaaccatatcaatccttataaactatggatttatgctccttaaaacaatatataatgctgatcactactataaatgcgtggttttaaccaactgtactgaaacagctttgagtttatattctgtttggatatttggagaaaacaacaagtgctctcaagagtatttgcttagaggccggctgtgtgagtggataactttgaaagctgcttttgagacgccagtgtctggcatttcctgcattctggcctggaggccggacgtgaatctgacttctagtaaaaatacacggttcccttgacaaagtcgagctgtttatcccagagactgcacaattttccgttgataggcatggaccaatgctaactggaaatcattgcaaaaagtttttttgtcgggcggagggtgtggtgttaagataaacagtgtgcaacagaagaaattaaaactggaagaaattaaagggttttttttagacttt

SEQ ID NO: 5650 - DNA, 1171 bp, Homo sapiens
gggagaggggaagcagatctgaggacatctctgtgccaggccagaaaccgcccacctgcagttccttctccgggatggacgtggggcccagctccctgccccaccttgggctgaagctgctgctgctcctgctgctgctgcccctcaggggccaagccaacacaggctgctacgggatcccagggatgcccggcctgcccggggcaccagggaaggatgggtacgacggactgccggggcccaagggggagccaggaatcccagccattcccgggatccgaggacccaaagggcagaagggagaacccggcttacccggccatcctgggaaaaatggccccatgggaccccctgggatgccaggggtgcccggccccatgggcatccctggagagccaggtgaggagggcagatacaagcagaaattccagtcagtgttcacggtcactcggcagacccaccagccccctgcacccaacagcctgatcagattcaacgcggtcctcaccaacccgcagggagattatgacacgagcactggcaagttcacctgcaaagtccccggcctctactactttgtctaccacgcgtcgcatacagccaacctgtgcgtgctgctgtaccgcagcggcgtcaaagtggtcaccttctgtggccacacgtccaaaaccaatcaggtcaactcgggcggtgtgctgctgaggttgcaggtgggcgaggaggtgtggctggctgtcaatgactactacgacatggtgggcatccagggctctgacagcgtcttctccggcttcctgctcttccccgactagggcgggcagatgcgctcgagccccacgggccttccacctccctcagcttcctgcatggacccaccttactggccagtctgcatccttgcctagaccattctccccaccagatggacttctcctccagggagcccaccctgacccacccccactgcaccccctccccatgggttctctccttcctctgaacttctttaggagtcactgcttgtgtggttcctgggacacttaaccaatgccttctggtactgccattcttttttttttttttttcaagtattggaaggggtggggagatatataaataaatcatgaaatcaatacataaaaaaaaaaaaaaaaaaaaaaaaaaaaaaaaa

SEQ ID NO: 5651 - DNA, 2345 bp, Homo sapiens
cgcctccagcctccaacgctcgccacagccctctcatctcctggaaccatggccagcacatccaccaccatcaggagccacagcagcagccgccggggtttcagtgccaactcagccaggctccctggggtcagccgctctggcttcagcagcatctccgtgtcccgctccaggggcagtggtggcctgggtggtgcatgtggaggagctggctttggcagccgcagtctgtatggcctggggggctccaagaggatctccattggagggggcagctgtgccatcagtggcggctatggcagcagagccggaggcagctatggctttggtggcgccgggagtggatttggtttcggtggtggagccggcattggctttggtctgggtggtggagccggccttgctggtggctttgggggccctggcttccctgtgtgcccccctggaggcatccaagaggtcaccgtcaaccagagtctcctgactcccctcaacctgcaaattgaccccgccatccagcgggtgcgggccgaggagcgtgagcagatcaagaccctcaacaacaagtttgcctccttcatcgacaaggtgcggttcctagagcagcagaacaaggttctggacaccaagtggaccctgctgcaggagcagggcaccaagactgtgaggcagaacctggagccgttgttcgagcagtacatcaacaacctcaggaggcagctggacagcatcgtcggggaacggggccgcctggactcggagctgagaaacatgcaggacctggtggaggacctcaagaacaaatatgaggatgaaatcaacaagcgcacagcagcagagaatgaatttgtgactctgaagaaggatgtggatgctgcctacatgaacaaggttgaactgcaagccaaggcagacactctcacagatgagatcaacttcctgagagccttgtatgatgcagagctgtcccagatgcagacccacatctcagacacatccgtggtgctatccatggacaacaaccgcaacctggacctggacagcatcatcgctgaggtcaaggcccaatacgaggagattgctcagaggagccgggctgaggctgagtcctggtaccagaccaagtacgaggagctgcaggtcacagcaggcagacatggggacgacctgcgcaacaccaagcaggagattgctgagatcaaccgcatgatccagaggctgagatctgagatcgaccatgtcaagaagcagtgtgccagcctgcaggctgccattgctgatgctgagcagcgtggggagatggcactcaaggatgctaagaacaagctggaagggctggaggatgccctgcagaaggccaagcaggacctggcccggctgctgaaggagtaccaggagctgatgaatgtcaagctggccctggatgtggagatcgccacctaccgcaagctgctggagggcgaggagtgcaggctgaatggcgaaggcgttggacaagtcaacgtctctgtagtacagtccaccatctccagtggctatggcggtgccagcggtgtcggcagtggcttaggcctgggtggaggaagcagctactcctatggcagtggtcttggcattggaggtggcttcagttccagcagtggcagagccattgggggtggcctcagctctgttggaggcggcagttccaccatcaagtacaccaccacctcctcctccagcaggaagagctacaagcactaaagtgctgcctccagctctcggtcccacagtcctcaggcccttctctggctgcagagccgtctcctcaggttgcctatcctctcctggcctctagtcttccctgctctccgaggtagagctgggtatggatgcttagtgccctcacttctctctgtctatacctgccccatctgagcacccattgctcaccatcagatcaacctttgattttacatcataatgtattcaccaatggagcttcactttgttactaaattattaatttcttgcctccaaaattgttctctctgaggctgagcattataagaaaatgatctctgttccttttcattactgaaaatcgcctggggcttatttcagaacaacttccacttattttccattggcccccaaactccctaagttaaaagtattgtgaacccccgccccgcagtatgcatggaagcacaagtgactagtcgtatgatgtacacagtctttctccctgtgatgatttctctgctctttgctctttgtaatttctaaataaagcaggttttagaataaaaaaaaaaaaaaaaaaaaaaaaaaaaaaaaaaaaaaaaaaaaaaaaaaaaaaaaaa

SEQ ID NO: 5652 - DNA, 4352 bp, Homo sapiens
ggaggagtttgttaatgttcagtttgttcagcgggatcgatgtttgctggcatcgcctcgccctgtcttgtgtgtgtgtgcgagggtgtgtgtgtgtgtttgtgtgtgtgtgcatatgtggggggtgtgagtgtgtgtgtgcgaggaagcgggggtgcgtgcgcgtgtgagtgcgtgtgtgagtgtctgtgtgtgtgtctgtgtgtgtgtgtgagtgagtgaattccagattttctgtctttccaaaacccgctcctgtcctctcgcatatcactcacagacggggatctgacagcagccacaaacctacagtgagtgatcgctctccccccggcacgaatccgccatagagatcggcgaggaggaggaggaggaggaggaagaaaagaaggaggaggtggaggaggaggtggaggaggaggaggaggagggaaagaggagaaggaagaagaagaaaaagaagaaacccactaccttcccaggattgccttttttttttccttatctttacgcgcgagtgtgcctgtggcgcgtgtgcgcccctcgtcccttccatccgaacccgggcttggatgtttaataaagaaatcaagtgtctcaacagtcaccaaaaaaaaaaaaaaccgcaaaaacaaaaccaaaaaaattccaaaagcaaaaacaaaaaagagagaggaaaaaaaattcaaaataaacaaacaaacaaacaaggcagaaccaacctctacttcaaagcagccggcacaagccacccgtgtctgccacccagagaggggggtctctggcccgtggtggaggagttgcaggggggatcgtcagggggacagaggccgagtgacgtcctaggagccaccgggcaagaggcggaggagacccagagaggccagagagacagcgggccccagcgcgcggctcggggctggggcgccagaagtgggactggagcgaagtagaggatgccgaggagaaaacagcaggcacccaagcgggcggcaggctacgcccaggaggaacagctgaaagaagaggaggaaataaaagaagaggaggaggaggaggacagcggttcagtagctcaactgcagggtggcaatgacacagggacggacgaggagctagaaacgggcccagagcaaaaaggctgcttcagctaccagaactctccaggaagtcatttgtccaatcaggatgccgagaacgagtctctgctgagtgacgccagtgatcaggtgtcggacatcaagagtgtctgcggcagagatgcctcagacaagaaagcacacactcacgtcaggcttccaaacgaagcacacaattgcatggataaaatgaccgctgtctacgccaacatcctgtcggattcctactggtcaggcctgggccttggcttcaagctgtccaatagtgagaggaggaactgtgacacccgaaacggcagcaacaagagtgattttgattggcaccaagacgctctgtccaaaagcctgcagcagaacttgccttctcggtccgtctcgaaacccagcctgttcagctcggtgcagttgtaccgacagagcagcaagatgtgcgggactgtgttcacaggggccagcagattccgatgccgacagtgcagcgcggcctatgacaccctagtcgagctgactgtgcacatgaatgaaacgggccactatcaagatgacaaccgcaaaaaggacaagctcagacccacgagctattcaaagcccaggaaaagggctttccaggatatggacaaagaggatgctcaaaaggttctgaaatgtatgttttgtggcgactcctttgattccctccaagatttgagcgtccacatgattaaaacaaaacattaccaaaaagtgcctttgaaggagccagtcccaaccatttcctcgaaaatggtcaccccggctaagaaacgcgtttttgatgtcaatcggccgtgttcccccgattcaaccacaggatcttttgcagattctttttcttctcagaagaacgccaacttgcagttgtcctccaacaaccgctatggctaccaaaatggagccagctacacctggcagtttgaggcctgcaagtcccagatcttaaagtgcatggagtgtgggagctcccatgacaccttgcagcagctcaccacccacatgatggtcacaggtcactttctcaaggtcaccagctctgcctccaagaaagggaagcagctggtattagacccgttagcagtggagaaaatgcagtcgttgtctgaggccccaaacagtgattctctggctcccaagccatccagtaactcagcatcagattgtacagcctctacaactgagttaaagaaagagagtaaaaaagaaaggccagaggaaaccagcaaggatgagaaagtcgtgaaaagcgaggactatgaagatcctctacaaaaacctttagaccctacaatcaaatatcaatacctaagggaggaagacttggaagatggctcaaagggtggaggggacattttgaaatctttggaaaatactgtcaccacagccatcaacaaagcccaaaacggggcccccagctggagtgcctaccccagcatccacgcagcctaccagctgtctgagggcaccaagccgcctttgcctatgggatcccaggtactgcagatccggcctaatctcaccaacaagctgaggcccattgcaccaaagtggaaagtgatgccactggtttctatgcccacacacctggccccttacactcaagtcaagaaagagtcagaagacaaagatgaagcggtgaaggagtgtgggaaagaaagtccccacgaagaggcctcatctttcagccacagtgagggcgattctttccgcaaaagtgaaacacctccagaagccaaaaagaccgagctgggtcccctgaaggaggaggagaagctgatgaaagagggcagcgagaaggagaaaccccagcccctggagcccacatctgctctgagcaatgggtgcgccctcgccaaccacgccccggccctgccatgcatcaacccactcagcgccctgcagtccgtcctgaacaatcacttgggcaaagccacggagcccttgcgctcaccttcctgctccagcccaagttcaagcacaatttccatgttccacaagtcgaatctcaatgtcatggacaagccggtcttgagtcctgcctccacaaggtcagccagcgtgtccaggcgctacctgtttgagaacagcgatcagcccattgacctgaccaagtccaaaagcaagaaagccgagtcctcgcaagcacaatcttgtatgtccccacctcagaagcacgctctgtctgacatcgccgacatggtcaaagtcctccccaaagccaccaccccaaagccagcctcctcctccagggtcccccccatgaagctggaaatggatgtcaggcgctttgaggatgtctccagtgaagtctcaactttgcataaaagaaaaggccggcagtccaactggaatcctcagcatcttctgattctacaagcccagtttgcctcgagcctcttccagacatcagagggcaaatacctgctgtctgatctgggcccacaagagcgtatgcaaatctctaagtttacgggactctcaatgaccactatcagtcactggctggccaacgtcaagtaccagcttaggaaaacgggcgggacaaaatttctgaaaaacatggacaaaggccaccccatcttttattgcagtgactgtgcctcccagttcagaaccccttctacctacatcagtcacttagaatctcacctgggtttccaaatgaaggacatgacccgcttgtcagtggaccagcaaagcaaggtggagcaagagatctcccgggtatcgtcggctcagaggtctccagaaacaatagctgccgaagaggacacagactctaaattcaagtgtaagttgtgctgtcggacatttgtgagcaaacatgcggtaaaactccacctaagcaaaacgcacagcaagtcacccgaacaccattcacagtttgtaacagacgtggatgaagaatagctctgcaggacgaatgccttagtttccactttccagcctggatcccctcacactgaacccttcttcgttgcaccatcctgcttctgacattgaactcattgaactcctcctgacaccctggctctgagaagactgccaaaaaaaaaaaaaaaaaaaaatcaccccagccatttctcttcatcctcactaacaatttggtaatgaagtattgatttccacttctctgcttatgggcggtattagattttcattgataaattgcaatggggctgtctcgtctccacagtaccc

SEQ ID NO: 5653 - DNA, 4152 bp, Homo sapiens
gccgtctcctccgcctcctcctcggtagttcacggctgccccggctccaggcctgtggaaatcgaatcaagggtttctggagtggagtgattccagctgctttgagctgaaggaaaagtagcctggccagtaaagcgtccgtgtgctggaggagtgcagccacccatcccggcgggccttgcaggacgaccgacaccaggaaggctttgtgccaggcccagcagccacccccagccgccttatgcaagtgggtacatgccctcgccagacgccagctttctgatctgcgtctttagattttttccatcgcctaagcgttacttctccactgatcggttttagagacctgaaacatcacagaagcttctgagtggttctgaagattcaagaggtttgcaggttgctatgttaatgttgtttgtctttggagtcttacttcatgaagtctcactgagtggtcagaatgaagctcctcctaatactcacagcattccaggcgaacctctgtataactatgccagcatccgcttgccagaggagcacattcccttctttttgcacaacaataggcatattgccactgtctgtaggaaagactctctttgtccatataagaaacacctagagaagctaaagtactgctggggttatgagaaatcctgcaaaccagagttcaggtttggttacccagtttgcagctatgtcgacatgggatggacggacactcttgagtcagctgaggacatattttggaaacaagctgactttggatatgccagagagaggctggaggagatgcatgtgctctgtcagcctaaggaaacgagtgactcaagtctggtgtgttcccgttatcttcagtactgcagggcaaccaatctctatcttgatttaagaaacatcaagagaaatcatgacagatttaaggaggactttttccagagtggtgaaattggagggcactgtaaacttgacatccgtacattgacgtctgaaggtcagcgcaaaagccctctgcagtcatggtttgctgagctacaaagctatactcagctcaacttcagacctatagaagatgctaaatgtgacattgtcattgaaaaaccaacatatttcatgaaattagatgcaggtgttaacatgtatcaccacttctgtgatttcatcaatctttatattactcagcacgttaataactcattcagtactgacgtgtacatcgtgatgtgggacaccgatggaaaaattcgagtcaccattcttgcacggagcacagaataccggaaaatccttaaccaaaatgagcttgtaaatgcactgaaaacagtatctacatttgaagtccagattgttgattacaagtatagagaacttgggtttttagatcaactaaggatcacacacaacacggacatatttattggaatgcatggagctggtctgacccatttacttttccttccagactgggctgctgtatttgaactgtacaactgtgaagatgaacgctgttacttagacttggccaggctgagaggcgttcactacatcacttggcgacggcagaacaaagtctttcctcaggataagggccaccatccaaccctgggggagcacccgaagttcaccaactactctttcgatgtagaagaatttatgtatcttgtccttcaggctgcagaccacgtattgcaacacccaaagtggccatttaagaagaaacatgatgagctataaatatgctgagtctgtttgcaaaaagagagtgtttaaacactccaacacccagacttagaattaaatcagtaaagcaatctgttatttcctatccccgaattaccttttctatgccaaaacataccttcaggatattgttatgtgttgtatagatgttaagtgtttcatgtggtttttgtgtcattgctatttatcaatagcaataattttgcactgaaaactttttatagttcaaaaattaagcatggactccccagtatactttaactttctttctttctttttttttttttggagacagagtctcactgtcacccaggctggagtgcagtggcatgatctcagtttatgcaacttctgcctccccaggttcaagcgattcttttgcctcagccacctgactagctgggattgcagcctgcaccaccacacctggctaaatttttgttgttgtcgttgagatacagtttcactctgtcacccaggctggagtgcagtggcatgatctcagctcactgcaacctctgccttctggattcaagtgattcttgtgccttagcctcccaagtagctgggattacaggcgtgcaccaccacgcccagttgatttttgtatttttgatagagacggagtttcaccatgttggccaggctggtctcgaactctgggttcaagaaatcctcccaccttgcctcccaaagtgctgggattacaggtgtgagccaccacgcatggccctgaactttctctttttaggaataccaaagttttcaactttttcagctttagaatttgtaaatatttttgtagaatatcatatgactgtaattccagagtgttccaacttgtttatgatatatttgggtaaatttacaactgttcttttatttgccataatctggttataacactgtttgtggtaggaaaggaaaacatgcaaaacatacacacacacacacacacacacacacacacgcagagttgtgattctcagtaccaagctataggaccatgttatagatcagcgtttagtcacctccaggttatatgcatcgagaacctgaataaatcatgccactatattaatttatattacatgtttcatatttaaatcatgttttcctaaaatgtagcaactacatgtgataaaagcaaattagaacattctgtaggactgtcttgcataccttctgtctggtttccactgattccttcttagccatggagagcatttgtgattaattaatttatatatgaaataatggtttccattttatgcgagtatttgtaactgcatataccagtgcgtgtgcgtctacctctgtcagcatgaaagtattccagtctttaatttcaaaaacttcaaattagcctcatgaagagaatttttccctgtgaaaagtaagaccaagaaaaaacaaactaaagacatgtgacttattcaatgaaagtgaaaaagaagctctaaaacagtgtcattgattaaaaagaatatctggaatgtagccccactctttgagtgggattcatttcttactgcttatgaactttcaatttagtagtcagaaaccatggatttattttactgcacaatgtgaagtttacattttattaacacttgagtagtctgatttagagactagttacttctattttttaaaataatggagtaacaaattacagaatagctaaataattttttaaaaatattttacagttgtaaaaaatatccatcagaaaaatgacacacaaaacaaaatatctggacctttacagaagacgtttgctgacccccactttaaaggattggaacagtcttctagaattgaggaatatttattaaaatacctgtaaagaaaatagtgaatcactgtagcaatggctttgattcagaccttaaaatcacataagaagaattacaacatgttatggatttttaagtggcaggtattgtaactgttttttgtgtgcaaaatactgagtaaccactgggaaaatatttcagatgaaagggatgacaaaagcatgttgcgctttgcatcagcaaggcattgacttctgaaaaaatgatctgaaaaaagtttcaccgtttgtcttcttacctcattttaagaagcatgtgaaaatgggatactatagactactgagaatttcagaaattgagaacaatttcataataaaacggctatatttgaagagagaatacattttatataaacaggaaaatacatttgacactttatggaattttatgagactttttgtgggaacagaaggtcttcaaattgtaaaatgtaaagattgctctttttattaagtctttaacagggatgtatttcattgtatgttttgggtatggctttggaataaatcattttatattttatttgaatatcagaaaaaaaaaaaaaaaa

SEQ ID NO: 5654 - DNA, 3257 bp, Homo sapiens
cagctgctcggcgcctgcagctccggctcgggggctggaaccgaagcgggggcggcgggagcgcggagaccacagcccccggggagaggcggagggggtccctggcctgggcggagaggctgagctgagtgcgcgtgagaaagagggctgcaccgctgctcggcgcggactctgccagccccagcttcagccccggctcaggtcgccgcagcccgggagcctccccgcttgcgccccaaggcacgcgcggcacagccatgaacaccaacgatgccaaggagtatctggcccggagggaaatccctcagctttttgagagccttttgaatggactgatgtgttctaagcccgaagatccagtagaatacttggaaagttgtttacaaaaagtaaaggaactgggtggctgtgacaaggtgaaatgggatacatttgtaagccaggaaaagaagaccttacctccactaaatggaggacagtcacggagatcctttctaagaaatgtaatgcctgaaaactcaaactttccatatcggcggtatgaccggctccctccaatccatcaattctccatagaaagtgacacggatctctctgagactgcagagttgattgaggagtatgaggtttttgatcctaccagacctcgaccaaaaatcattcttgttataggtggtccaggaagtggaaagggtactcagagtttgaaaattgcagaacgatatggattccaatacatttctgtgggagaattattaagaaagaagatccacagtaccagcagcaataggaaatggagtcttattgccaagataattacaactggagaattggccccacaggaaacaacaattacagagataaaacaaaaattgatgcaaatacctgatgaagagggcattgttattgatggatttccaagagatgttgcccaggctctatcttttgaggaccaaatctgtacccccgatttggtggtattcctggcttgtgctaatcagagactcaaagaaagattactgaagcgtgcagaacagcagggccgaccagacgacaatgtaaaagctacccaaaggagactaatgaacttcaagcagaatgctgctccattggttaaatacttccaggaaaaggggctcatcatgacatttgatgccgaccgcgatgaggatgaggtgttctatgacatcagcatggcagttgacaacaagttatttccaaacaaagaggctgcagcaggttcaagtgaccttgatccttcgatgatattggacactggagagatcattgatacaggatctgattatgaagatcagggtgatgaccagttaaatgtatttggagaggacactatgggaggtttcatggaagatttgagaaagtgtaaaattattttcataattggtggtcctggctctggcaaaggcacacagtgtgaaaagctggtggaaaaatatggatttacacatctctcaactggcgagctcctgcgtgaggaactggcatcagaatctgaaagaagcaaattgatcagagacattatggaacgtggagacctggtgccctcaggcatcgttttggagctcctgaaggaggccatggtggccagcctcggggacaccaggggcttcctgattgacggctatcctcgggaggtgaagcaaggggaagagttcggacgcaggattggagacccacagttggtgatctgtatggactgctcggcagacaccatgaccaaccgccttctccaaaggagccggagcagcctgcctgtggacgacaccaccaagaccatcgccaagcgcctagaagcctactaccgagcgtccatccccgtgatcgcctactacgagacaaaaacacagctacacaagataaatgcagagggaacaccagaggacgtttttcttcaactctgcacagctattgactctattttctgaaggcaaaaatgcatgtttgttagaatggaaacagaaaaacattaaaaagttcattccttaacacaatgtttcaagttaaaccttttgtgtcaccgcccccaccaaccaccacctcctaaatcctgacagcactgtttgcttcccagctagacctgtgtgagaggtgtctggaaatcatgcatggtgtatttgggactatatcaacctattctccacacttcagacaactgtctgcactcacggcacacacactttgtatcatgcaggccacactcagagctagtcagtacatgaacagtggtgcggtgccagtctgtgtccgttgtgatcacaggccttgctagaccctgatcatctggttctcctctcattaagcatccctaacccccagtcacaccttcctcttacatactgttccccaatggaggcccctggcataggggacagccctgggcatcttcctttggtgtctggctgttttgtcaactctcatccactggtggctcagagccataaggtgggttgattacacaatgccttgtacatgatatagaggcatcaagcaagtaaaatttgacagaaattttaaaatatgaagatgtatagctttcccaagatgatggtaaaacccaggttagtcatcagtaaccttctctattattattattttttagaaacttggaatactgtcgtcatggctaagagaacaaatctgataaattgtgtaacctagtctcttctctacatggtgatgcatttcagcaattataaattaatataaatgaccaaaagtaacttaaaagcatgagatatttgctatttcattcattgggcacatatcaaattataattttgattttaaatggtcacccatgtatttatttgttgccaagcaagtaaaaaaataccctaacaaacctgatgtgggtgggaggggcatgtcagtaagtggtgtgttcaatgtgtttgtttcatatgggccctttccaggagtttgcaaaccttgtcatacccatatgcaaaactgtgtttccttgcattaaaccagtgaagtttgggttctcttttgtgctatcaatcagttgtaaaatcagagctgcttatatattctactggaataactgcatcttccactcagtcactacaaaaaagcatagtttcagtttgcatgaatttttttttttttcttcaatggctgtgcagataaggatccatttctgggatagaattgtattttttaagtcatttttttttcttgaaatggatatgtacaaataaaataaatggaagacaggataaaaaaaaaaaaaa

SEQ ID NO: 5655 - DNA, 4205 bp, Homo sapiens
ccgccgccactgccgtcgggtaaggtcccagcacggacatggcctcgcgcggcgcccgcccgggcccgagtcccccgcgccccgctttgtagccccccggcggagaggcggcctcgacggtgcggacggcgcagacggccgggcgggcggcatggaggcggcgcatctgctcccggccgccgacgtgctgcgccacttctcggtgacagccgagggcggcctgagcccggcgcaggtgaccggcgcgcgggagcgctacggccccaacgagctcccgagtgaggaagggaagtccctgtgggagctggtgctggaacagtttgaggacctcctggtgcgcatcctgctgctggctgcccttgtctcctttgtcctggcctggttcgaggagggcgaggagaccacgaccgccttcgtggagcccctggtcatcatgctgatcctcgtggccaacgccattgtgggcgtgtggcaggaacgcaacgccgagagtgccatcgaggccctgaaggagtatgagcctgagatgggcaaggtgatccgctcggaccgcaagggcgtgcagaggatccgtgcccgggacatcgtcccaggggacattgtagaagtggcagtgggggacaaagtgcctgctgacctccgcctcatcgagatcaagtccaccacgctgcgagtggaccagtccatcctgacgggtgaatctgtgtccgtgaccaagcacacagaggccatcccagaccccagagctgtgaaccaggacaagaagaacatgctgttttctggcaccaatatcacatcgggcaaagcggtgggtgtggccgtggccaccggcctgcacacggagctgggcaagatccggagccagatggcggcagtcgagcccgagcggacgccgctgcagcgcaagctggacgagtttggacggcagctgtcccacgccatctctgtgatctgcgtggccgtgtgggtcatcaacatcggccacttcgccgacccggcccacggtggctcctggctgcgtggcgctgtctactacttcaagatcgccgtggccctggcggtggcggccatccccgagggcctcccggctgtcatcactacatgcctggcactgggcacgcggcgcatggcacgcaagaacgccatcgtgcgaagcctgccgtccgtggagaccctgggctgcacctcagtcatctgctccgacaagacgggcacgctcaccaccaatcagatgtctgtctgccggatgttcgtggtagccgaggccgatgcgggctcctgccttttgcacgagttcaccatctcgggtaccacgtatacccccgagggcgaagtgcggcagggggatcagcctgtgcgctgcggccagttcgacgggctggtggagctggcgaccatctgcgccctgtgcaacgactcggctctggactacaacgaggccaagggtgtgtatgagaaggtgggagaggccacggagacagctctgacttgcctggtggagaagatgaacgtgttcgacaccgacctgcaggctctgtcccgggtggagcgagctggcgcctgtaacacggtcatcaagcagctgatgcggaaggagttcaccctggagttctcccgagaccggaaatccatgtccgtgtactgcacgcccacccgccctcaccctactggccagggcagcaagatgtttgtgaagggggctcctgagagtgtgatcgagcgctgtagctcagtccgcgtggggagccgcacagcacccctgacccccacctccagggagcagatcctggcaaagatccgggattggggctcaggctcagacacgctgcgctgcctggcactggccacccgggacgcgcccccaaggaaggaggacatggagctggacgactgcagcaagtttgtgcagtacgagacggacctgaccttcgtgggctgcgtaggcatgctggacccgccgcgacctgaggtggctgcctgcatcacacgctgctaccaggcgggcatccgcgtggtcatgatcacgggggataacaaaggcactgccgtggccatctgccgcaggcttggcatctttggggacacggaagacgtggcgggcaaggcctacacgggccgcgagtttgatgacctcagccccgagcagcagcgccaggcctgccgcaccgcccgctgcttcgcccgcgtggagcccgcacacaagtcccgcatcgtggagaacctgcagtcctttaacgagatcactgctatgactggcgatggagtgaacgacgcaccagccctgaagaaagcagagatcggcatcgccatgggctcaggcacggccgtggccaagtcggcggcagagatggtgctgtcagatgacaactttgcctccatcgtggctgcggtggaggagggccgggccatctacagcaacatgaagcaattcatccgctacctcatctcctccaatgttggcgaggtcgtctgcatcttcctcacggcaattctgggcctgcccgaagccctgatccctgtgcagctgctctgggtgaacctggtgacagacggcctacctgccacggctctgggcttcaacccgccagacctggacatcatggagaagctgccccggagcccccgagaagccctcatcagtggctggctcttcttccgatacctggctatcggagtgtacgtaggcctggccacagtggctgccgccacctggtggtttgtgtatgacgccgagggacctcacatcaacttctaccagctgaggaacttcctgaagtgctccgaagacaacccgctctttgccggcatcgactgtgaggtgttcgagtcacgcttccccaccaccatggccttgtccgtgctcgtgaccattgaaatgtgcaatgccctcaacagcgtctcggagaaccagtcgctgctgcggatgccgccctggatgaacccctggctgctggtggctgtggccatgtccatggccctgcacttcctcatcctgctcgtgccgcccctgcctctcattttccaggtgaccccactgagcgggcgccagtgggtggtggtgctccagatatctctgcctgtcatcctgctggatgaggccctcaagtacctgtcccggaaccacatgcacgcctgtctttatccaggccttctcaggacagtctcgcaggcctggagtaggcagccgctgaccacctcttggaccccagaccacaccgggttggcctctttgaagaaatgagccagaagtgagcgctgggaacagagtggagtctccgggcccgggcgggtgaagggtcagagagacggacacaaggagccggcaggagggcggagcgaggatgtcctttcccgggagacaagtcgggaaagcctggctggactgcctcagccccgcgcgcctcctggactcagggttccccgtcctgagctcgggagatgttcagagtcacactgccgcccggtctgccacgcagaggtccaacttgccacccgcgtccctggtacctgagaccaccgacatcctcaggttcctgaccgtggcgcccttctacccagcccagtgtgcggccgccgcgctgtctgcacagctgggggcctctgagcctggtgggcttcctggactcttggcctcactccttgccccctccccacgacacccatgagccgaaaggatgtcactaaggatggctgattccccaagggcacccgctctccctccctccctgctggaggaacacgtcatatcagatgagaggaagatggcctctgatggacagaatttttctcttaactcagcttttgctactttggcaaaaactagcgaggggtagcagaaacctgcaccaaggattgtccctatgtcttggccactcctagagcgtgtgcagactgatgattttatatgtaaatcaagactcacatccctttcctagtcccccacatccaaagcccctcagcctgccttgcagaccaatgggctccatgttctgtagccccctcccctacgcctcacccctcctccctctcacaggttctgggcggccagtgagagaaacgcagtgggggaggcagggagtctggtgcctgcagagattctctgcttctttcctggggggaggtggggaggtcttagcaggagcgggccctgtacccacctgctgacctgctgtttggtagagaaataaaggttgtgtgactggggg

SEQ ID NO: 5656 - DNA, 3120 bp, Homo sapiens
atgccgcggctcccggtgaagaagatccgtaagcagatgaagctgctgctgctgctgctgctgctgagctgcgccgcgtggctcacctacgtgcacctgggcctggtgcgccagggacgcgcgctgcgccagcgcctgggctacgggcgagatggtgagaagctgaccagtgagaccgacggccggggggtccacgctgcgccatccacacagagggctgaggactccagtgagagccgtgaagaggagcaagcgcccgaaggtcgggacctagacatgctgtttcctgggggggctgggaggctgccactgaacttcacccatcagacacccccatggcgggaggagtacaaggggcaggtgaacctgcacgtgtttgaggactggtgtgggggcgccgtgggccacctgaggaggaacctgcacttcccgctgttccctcatacgcgcaccaccgtgaagaagttggccgtgtcccccaagtggaagaactatggactccgtatttttggtttcatccacccggcgagggacggagacgtccagttttctgtggcctcagacgacaactcggagttctggctgagtctggacgagagccctgctgctgcccagcttgtggcctttgtgggcaagactggctccgagtggacagcgcctggagaattcaccaagttcagctcccaggtgtccaagcccaggcggctcatggcctcccggaggtactactttgagttgctgcacaagcaggacgaccgcggctcggaccacgtggaagtgggctggcgagctttcctgcccggcctgaagttcgaggtcatcagctctgctcacatctccctgtacacagatgagtcagccttgaagatggaccacgtggcgcacgtcccccagtctccagccagccacgtgggggggcgtccgccgcaggaggagaccagcgcagacatgctgcggccagatcccagggatacctttttcctcactccacgcatggaatcttcgagcctggagaacgtgctggagccctgcgcctacgcccccacctacgtggtcaaggacttcccgatcgccagataccagggcctgcaatttgtgtacctgtccttcgtttatcccaacgactacactcgcctcacccacatggagacggacaacaagtgcttctaccgcgagtctccgctgtatctggagaggtttgggttctataaatacatgaagatggacaaggaggagggggatgaggatgaagaagacgaggtgcagcgccgagccttcctcttcctcaacccggacgacttcctggacgacgaggacgagggggagctgctcgacagcctggagcccaccgaggcggccccgcccaggagcggcccccagtcccccgccccagcagcccccgcccagcccggagccaccctcgccccgccgacccctccccgcccccgggacggggggacccccaggcactcccgggccctgagctgggccgccagggccgcccgccctttgccgctcttcttgggccgagctccgcccccgcgccctgcagtggagcagccgcccccaaaggtgtacgtgaccagggtgcggccgggacagcgggcatccccccgggccccagcgccgcgtgcgccctggccgcccttccctggcgtcttcctgcaccccaggcctctgcccagagtgcagctgcgggcgcccccacgcccaccccggccccacggccgcaggaccggcggcccccaggccacacagccgaggcccccagcccgggcgcaggccacccaagggggccgggagggccaggcgcgcacgctgggacctgcggcgcccacagtggactcaaacttgtcctccgaagcgcggcccgtgacctccttcctgagcttgtcccaggtgtccgggccgcagctgcccggggagggcgaagaggaggaggaaggggaggacgatggggccccgggcgacgaggccgcgtcggaggacagcgaggaggccgcgggcccggcgctcggacgctggcgtgaggacgccatcgactggcagcgcacgttcagcgtgggcgccgtggacttcgagctgctgcgctcggactggaacgacctgcgatgcaacgtttcggggaacctgcagctgccggaggcggaggccgtggacgtgaccgctcagtacatggagcggctgaacgcgcgccacggcgggcgcttcgcgcttctgcgcatcgtgaacgtggagaagcgccgggactcggcgcgagggagtcgcttcctgctggagctggagctgcaggagcgcgggggcggccgcctgcgactgtccgagtacgtcttcctgcggctgccgggagcccgcgtaggggatgcagacggagaaagtcccgaacccgctcccgccgcctccgtgcgccccgacggccgccccgagctctgccggccactgcgcctggcctggcgccaggacgtgatggttcacttcatcgtgccagtgaaaaaccaggcacggtgggtggcacagttcctggcggacatggctgcgctgcacgcgcgcaccggggactcgcgtttcagcgtcgtcctggtggatttcgagagcgaggatatggacgtggagcgggccctgcgcgccgcgcgcctgccccggtaccagtacctgagacgaaccgggaacttcgagcgctccgccgggctgcaggcgggagtggacgcggtagaggacgccagcagcatcgtgttcctctgcgacctgcacatccacttcccacccaacatcctggacggcatccgcaagcactgcgtggagggcaggctggccttcgcgcccgtggtcatgcgcctgagctgcgggagctcgccccgggacccccacggttactgggaggtgaacggctttggcctttttgggatctacaagtcggactttgaccgggttggaggaatgaacacggaggagttccgagaccagtgggggggtgaagactgggagctcctggacagggtcctgcaggcagggctggaggtggagcggctccgactgcggaatttctatcaccactaccactccaagaggggcatgtggagcgtccgcagcaggaagggctctcgcacgggggcgtcttga

SEQ ID NO: 5657 - DNA, 1692 bp, Homo sapiens
atgatattctgttctcttgggacattacagttttgcatagacaaggtgaacatttctcaaaacaccatgtctctccaattttctaatggatccaggcatgtttgcttaaggtctggagctggatctgtcagacccctcaatggaggtgcaggctttgcaggcagcagtgcatgtggtggctctgttgctggaagtgaattttcctgtgccttgggagggggcttgggcagtgttcctggtgggagccatgctggtggtgcccttggaaatgctgcttgtattggctttgctggaagcgaagggggactcctctctggaaatgagaaggtgaccatgcaaaatcttaatgaccgcttggcatcctacctggataatgtgcgagctctggaggaggcaaatgctgaattagagagaaaaatcaagggttggtatgaaaaatacggacctggatcttgccgtggacttgatcatgactatagcagatatcacctaacaattgaggatcttaagaataagattatctcctccactactactaatgctaatgtcattctgcagattgataatgccagactggctgctgatgatttcaggctaaagtatgaaaatgagctcacccttcaccaaaacgtagaggccgacatcaacggattacggcgagtcctggacgagctgacgctctgcaggaccgaccaggagctgcaatatgagtctctgagtgaggagatgacatatctcaaaaagaaccacgaagaggagatgaaggctctgcagtgcgcggctgggggcaacgtgaacgtggagatgaacgcggccccgggggtagacctcgcggttttgttgaacaacatgcgagcggagtacgaagcccttgcagagcagaaccgcaaggacgcggaggcctggttcaatgagaagagcgcctcgctgcagcaacagatctcccacgactcaggcgcagccactttcgcccggagccagctcaccgagatgaggcgcaccctgcagaccctggagatccagctgcagtccctgatggccacgaaacactccctggagtgctccttgacagagaccgagagcaactactgtacgcagctggcgcagatccaggctcagatcggggccctggaggagcagctgcaccaggtcagaaccgagaccgagggccagaagctggagtatgagcatctcctcgatgtcaaggtccacttggaaaaagaaattgagacctactgccgcctgatagatggagatggaaattcatgctccaaatcaaagggctttggatcaggaagccctgggaattcatctaaagatttatccaaaaccacactggtaaagacagtggttgaagagctagatcaacgtggtaaagttctttcatcaaggattcactccattgaagaaaagacatctaaaatgaccaacggcaagacagaacaaagggttcctttctagctgtcattttagagaaaagaataatttgggaaaggatcctgtacaattgcattattctaaatatcagagagaatatacacactttttacttttaaagatacattacttagcaaaaatacctgttttcttagttttacaggatattgagtgtttgtttccaataaataaaaaagttgatgtgcattcatttccattcactgatgactaataaataactatttgtgatttttt

SEQ ID NO: 5658 - DNA, 1490 bp, Homo sapiens
aaacgcgggcgggcgggcccgcagtcctgcagttgcagtcgtgttctccgagttcctgtctctctgccaacgccgcccggatggcttcccaaaaccgcgacccagccgccactagcgtcgccgccgcccgtaaaggagctgagccgagcgggggcgccgcccggggtccggtgggcaaaaggtgagtgatgcggcctaccactcgccgggcctgccatgccctaggcattggtacccagagcaaagatttctaggaccaccccccgccgccacctcctggagcgggagatctgcgggtgcaggagaacacaccaggagctcggggcctggcattcccctgggcatgggtgtcgagggcggagacttccgggactcccacctccttgcgcgggtgagattcgagagatgggggacaggccaggagctcagaccgctctttgagactctcccgaaggagaatgggagggtaggggcgctgccagactccttccctggtgggcctagatgaagacgctcaaggaccctcgtgacttggccgagacaggggaagggagaagttgagtcgggcaaggaagagatgctaaagcctggggaattaagaacatgccagaatcatcccgagggagtctggaattagggagggtgaggactcgctaggatcgtcctgtggatctggtgagtataccctgagctgagcctgaccttggtgatgtggggagcctccatgacggctccccctgagattcaggtgggagaagatgcaccgtctggaggcctggcccatccagactcccaggtaaccccgaatactcttttttcaggctacagcaggagctgatgaccctcatgatgtctggcgataaagggatttctgccttccctgaatcagacaaccttttcaaatgggtagggaccatccatggagcagctggaacagtatatgaagacctgaggtataagctctcgctagagttccccagtggctacccttacaatgcgcccacagtgaagttcctcacgccctgctatcaccccaacgtggacacccagggtaacatatgcctggacatcctgaaggaaaagtggtctgccctgtatgatgtcaggaccattctgctctccatccagagccttctaggagaacccaacattgatagtcccttgaacacacatgctgccgagctctggaaaaaccccacagcttttaagaagtacctgcaagaaacctactcaaagcaggtcaccagccaggagccctgacccaggctgcccagcctgtccttgtgtcgtctttttaatttttccttagatggtctgtcctttttgtgatttctgtataggactctttatcttgagctgtggtatttttgttttgtttttgtcttttaaattaagcctcggttgagcccttgtatattaaataaatgcatttttgtccttttttagacaaaaaaaaaaaaaaaaaaaaaaaaaaaaaaaaaaaaaaaaaa

SEQ ID NO: 5659 - DNA, 7335 bp, Homo sapiens
tgggggcagcggagggaggggtgggaagcaccatgcagtttgtatcctgggccacactgctaacgctcctggtgcgggacctggccgagatggggagcccagacgccgcggcggccgtgcgcaaggacaggctgcacccgaggcaagtgaaattattagagaccctgagcgaatacgaaatcgtgtctcccatccgagtgaacgctctcggagaaccctttcccacgaacgtccacttcaaaagaacgcgacggagcattaactctgccactgacccctggcctgccttcgcctcctcctcttcctcctctacctcctcccaggcgcattaccgcctctctgccttcggccagcagtttctatttaatctcaccgccaatgccggatttatcgctccactgttcactgtcaccctcctcgggacgcccggggtgaatcagaccaagttttattccgaagaggaagcggaactcaagcactgtttctacaaaggctatgtcaataccaactccgagcacacggccgtcatcagcctctgctcaggaatgctgggcacattccggtctcatgatggggattattttattgaaccactacagtctatggatgaacaagaagatgaagaggaacaaaacaaaccccacatcatttataggcgcagcgccccccagagagagccctcaacaggaaggcatgcatgtgacacctcagaacacaaaaataggcacagtaaagacaagaagaaaaccagagcaagaaaatggggagaaaggattaacctggctggtgacgtagcagcattaaacagcggcttagcaacagaggcattttctgcttatggtaataagacggacaacacaagagaaaagaggacccacagaaggacaaaacgttttttatcctatccacggtttgtagaagtcttggtggtggcagacaacagaatggtttcataccatggagaaaaccttcaacactatattttaactttaatgtcaattgtagcctctatctataaagacccaagtattggaaatttaattaatattgttattgtgaacttaattgtgattcataatgaacaggatgggccttccatatcttttaatgctcagacaacattaaaaaacttttgccagtggcagcattcgaagaacagtccaggtggaatccatcatgatactgctgttctcttaacaagacaggatatctgcagagctcacgacaaatgtgataccttaggcctggctgaactgggaaccatttgtgatccctatagaagctgttctattagtgaagatagtggattgagtacagcttttacgatcgcccatgagctgggccatgtgtttaacatgcctcatgatgacaacaacaaatgtaaagaagaaggagttaagagtccccagcatgtcatggctccaacactgaacttctacaccaacccctggatgtggtcaaagtgtagtcgaaaatatatcactgagtttttagacactggttatggcgagtgtttgcttaacgaacctgaatccagaccctaccctttgcctgtccaactgccaggcatcctttacaacgtgaataaacaatgtgaattgatttttggaccaggttctcaggtgtgcccatatatgatgcagtgcagacggctctggtgcaataacgtcaatggagtacacaaaggctgccggactcagcacacaccctgggccgatgggacggagtgcgagcctggaaagcactgcaagtatggattttgtgttcccaaagaaatggatgtccccgtgacagatggatcctggggaagttggagtccctttggaacctgctccagaacatgtggagggggcatcaaaacagccattcgagagtgcaacagaccagaaccaaaaaatggtggaaaatactgtgtaggacgtagaatgaaatttaagtcctgcaacacggagccatgtctcaagcagaagcgagacttccgagatgaacagtgtgctcactttgacgggaagcattttaacatcaacggtctgcttcccaatgtgcgctgggtccctaaatacagtggaattctgatgaaggaccggtgcaagttgttctgcagagtggcagggaacacagcctactatcagcttcgagacagagtgatagatggaactccttgtggccaggacacaaatgatatctgtgtccagggcctttgccggcaagctggatgcgatcatgttttaaactcaaaagcccggagagataaatgtggggtttgtggtggcgataattcttcatgcaaaacagtggcaggaacatttaatacagtacattatggttacaatactgtggtccgaattccagctggtgctaccaatattgatgtgcggcagcacagtttctcaggggaaacagacgatgacaactacttagctttatcaagcagtaaaggtgaattcttgctaaatggaaactttgttgtcacaatggccaaaagggaaattcgcattgggaatgctgtggtagagtacagtgggtccgagactgccgtagaaagaattaactcaacagatcgcattgagcaagaacttttgcttcaggttttgtcggtgggaaagttgtacaaccccgatgtacgctattctttcaatattccaattgaagataaacctcagcagttttactggaacagtcatgggccatggcaagcatgcagtaaaccctgccaaggggaacggaaacgaaaacttgtttgcaccagggaatctgatcagcttactgtttctgatcaaagatgcgatcggctgccccagcctggacacattactgaaccctgtggtacagactgtgacctgaggtggcatgttgccagcaggagtgaatgtagtgcccagtgtggcttgggttaccgcacattggacatctactgtgccaaatatagcaggctggatgggaagactgagaaggttgatgatggtttttgcagcagccatcccaaaccaagcaaccgtgaaaaatgctcaggggaatgtaacacgggtggctggcgctattctgcctggactgaatgttcaaaaagctgtgacggtgggacccagaggagaagggctatttgtgtcaatacccgaaatgatgtactggatgacagcaaatgcacacatcaagagaaagttaccattcagaggtgcagtgagttcccttgtccacagtggaaatctggagactggtcagagtgcttggtcacctgtggaaaagggcataagcaccgccaggtctggtgtcagtttggtgaagatcgattaaatgatagaatgtgtgaccctgagaccaagccaacatctatgcagacttgtcagcagccggaatgtgcatcctggcaggcgggtccctggggacagtgcagtgtcacttgtggacagggataccagctaagagcagtgaaatgcatcattgggacttatatgtcagtggtagatgacaatgactgtaatgcagcaactagaccaactgatacccaggactgtgaattaccatcatgtcatcctcccccagctgccccggaaacgaggagaagcacatacagtgcaccaagaacccagtggcgatttgggtcttggaccccatgctcagccacttgtgggaaaggtacccggatgagatacgtcagctgccgagatgagaatggctctgtggctgacgagagtgcctgtgctaccctgcctagaccagtggcaaaggaagaatgttctgtgacaccctgtgggcaatggaaggccttggactggagctcttgctctgtgacctgtgggcaaggtagggcaacccggcaagtgatgtgtgtcaactacagtgaccacgtgatcgatcggagtgagtgtgaccaggattatatcccagaaactgaccaggactgttccatgtcaccatgccctcaaaggaccccagacagtggcttagctcagcaccccttccaaaatgaggactatcgtccccggagcgccagccccagccgcacccatgtgctcggtggaaaccagtggagaactggcccctggggagcatgttccagtacctgtgctggcggatcccagcggcgtgttgttgtatgtcaggatgaaaatggatacaccgcaaacgactgtgtggagagaataaaacctgatgagcaaagagcctgtgaatccggcccttgtcctcagtgggcttatggcaactggggagagtgcactaagctgtgtggtggaggcataagaacaagactggtggtctgtcagcggtccaacggtgaacggtttccagatttgagctgtgaaattcttgataaacctcccgatcgtgagcagtgtaacacacatgcttgtccacacgacgctgcatggagtactggcccttggagctcgtgttctgtctcttgtggtcgagggcataaacaacgaaatgtttactgcatggcaaaagatggaagccatttagaaagtgattactgtaagcacctggctaagccacatgggcacagaaagtgccgaggaggaagatgccccaaatggaaagctggcgcttggagtcagtgctctgtgtcctgtggccgaggcgtacagcagaggcatgtgggctgtcagatcggaacacacaaaatagccagagagaccgagtgcaacccatacaccagaccggagtcggaacgcgactgccaaggcccacggtgtcccctctacacttggagggcagaggaatggcaagaatgcaccaagacctgcggcgaaggctccaggtaccgcaaggtggtgtgtgtggatgacaacaaaaacgaggtgcatggggcacgctgtgacgtgagcaagcggccggtggaccgtgaaagctgtagtttgcaaccctgcgagtatgtctggatcacaggagaatggtcagagtgctcagtgacctgtggaaaaggctacaaacaaaggcttgtctcgtgcagcgagatttacaccgggaaggagaattatgaatacagctaccaaaccaccatcaactgcccaggcacgcagccccccagtgttcacccctgttacctgagggactgccctgtctcggccacctggagagttggcaactgggggagctgctcagtgtcttgtggtgttggagtgatgcagagatctgtgcaatgtttaaccaatgaggaccaacccagccacttatgccacactgatctgaagccagaagaacgaaaaacctgccgtaatgtctataactgtgagttaccccagaattgcaaggaggtaaaaagacttaaaggtgccagtgaagatggtgaatatttcctgatgattagaggaaagcttctgaagatattctgtgcggggatgcactctgaccaccccaaagagtacgtgacactggtgcatggagactctgagaatttctccgaggtttatgggcacaggttacacaacccaacagaatgtccctataacgggagccggcgcgatgactgccaatgtcggaaggattacacggccgctgggttttccagttttcagaaaatcagaatagacctgaccagcatgcagataatcaccactgacttacagtttgcaaggacaagcgaaggacatcccgtcccttttgccacagccggggattgctacagcgctgccaagtgcccacagggtcgttttagcatcaacctttatggaaccggcttgtctttaactgaatctgccagatggatatcacaagggaattatgctgtctctgacatcaagaagtcgccggatggtacccgagtcgtagggaaatgcggtggttactgtggaaaatgcactccatcctctggtactggcctggaggtgcgagttttatagctaaggtgctttgaagaggaagccattatggatggatgaaggatagtaatgcaatacctccaccttaatttgggtgcatgtgtatgtgtgtgtgtgtttgtgtgtgacttgtatgcttgtgtgtgtaaatgtgtgtacatatacatatatacatatctacacatacatatatacacatatatgtgtgtatgtagatatgtagactatcctaatgatgtaaagtttaatatttatgtttgaaattatttattgtgatgtaatatttttgtacgtaaaatgattctattatgactgcctttgcatgtagtaatatgacaaagtgatccttcattatcacggtacactattgtttacttttcatctgtaaatgttttattgttacttttttaaaatgaatttttttaaaacaatctagccatcatcaaggtgctataagagttgtataaaagatatttttggcatttctaggcaagtatcagccaataagtatgttagtgatatcacagattgtaccaactattaactatgttaaataagtattcagtttcatgtgatctctgggaaaaaaatatgctgccttggtgctaatattgtatgtatttaaatgatcatccgactcagaaatataaacacttttaatgaaagggaggaacggaaggacaatttccagtgcacagaatcacttggatgaaataagaccagctctttacccttatttttggatatgccttttttggaagagacttagactttatccttattgttgttagtgttgttaatattcgttgcttcagcccacggtgccttggtctctccacaatcaaatggaggatcccccaagcagcttcattacagagtgatattgggaaagtgagatcctctcaccattttgccaagatactctaaaatgacatccaagtttaccagtagaaagacacaggatgcacagaatgggcatgaccttcagctcacgagcacacctggagaaattcagaaccaggttctgaatcatcacgattgccttttgcatgaaaacatcggctggtgatgtgacttctcttcaggccatgagcctaacaccctgccggttttcatgcccgctgcagtaatggacgtttgtgtgaagaaatgaactgtggagtacaaaatgctttgagtctttccgattgctcattaattcacttttttgttacttctttccaaaatggaagtgctgaagccatggtctttctgcccctccaagctgatgaagggaagcctttgccaatggcccatggaagacacttggtttgagaaaccctgcccacttccaaagaccaaagagattaggaaaagcctggcagtattctccaactccaaacaagctctagagtgctccaggaaaagttatattcagtatatgaataagtgttattctccattattaatgtgttctgaaaatatattatgaataaatacatcaccacacccaaaaaaaaaaaaaaaaaaaaaaaaa

SEQ ID NO: 5660 - DNA, 15353 bp, Homo sapiens
cggcggccaggaaatgccgcagatgcgccgcgcagcatccccggtgaaggcagcgcgccggtcctcccgcaccgctgccgcggcctcggcccggcccgaagcacgcgcctcgtgcagggccagcagagcggtcagcgcggccgcagagggtccgggcgcccgccggcccccgcccgccctcgccgcacgccccgctcctccgcttggcgtggcgctgctcgtcgccgcccctgggctcgctgagatttgccgctgctgaaacccgagagggactcgggctcccggagccgggcggcccaccatcggcctgcccggaggcctgggcgtttcctttgccggccctggcgccggcagccccctgcgcccccgctctgcgtcttcggcttccgtgcttctccccagcgtgctgctccttcctcttttccagttcccaaggctgtgtcttgctgactgcgatactgtccgggggttacgagggggagaggggaatttgtcagtcatcgcttagataaacttcggcatggcgggttacctctcccctgctgcttacctgtacgtggaggagcaggagtatctccaggcctacgaggatgtcctggagaggtacaaagatgaacgggacaaagttcagaagaaaacatttacaaaatggataaatcagcatctcatgaaggttcgaaaacatgtgaatgatctctatgaagacttaagggatggacacaatttgatttctcttttagaggttctttcaggagataccttgcccagagaaaaaggtcggatgcgttttcacagactacagaatgtacaaattgcacttgactatttgaaaagacgccaggtgaaattagtgaatattagaaatgatgacataacagatggaaatcccaaattgactttgggattaatctggacaataattttgcactttcagatatctgatatccatgttactggagagtcagaggatatgtctgcaaaagagagattgctactctggacgcagcaggcaacagagggttatgctggaattcggtgtgaaaatttcactacctgctggagagatggaaaattatttaatgccatcattcataaatacaggccggacctgatagatatgaatactgttgctgttcaaagcaaccttgcaaatttagagcatgctttttacgtagcagaaaaaattggtgttataagacttctggaccctgaagatgtcgatgtctcctcacctgatgaaaaatcagtaataacttacgtgtcatctctctatgatgcatttcctaaagtccctgaaggtggggaaggcattggtgcaaatgatgttgaagtcaaatggattgaataccagaatatggtgaactacctcatccaatggattagacaccatgtgaccacaatgtctgagagaacatttcctaataatcctgtagaactgaaggcactttataatcagtatttacagtttaaagaaacagaaattccaccaaaggagacagaaaaatcaaaaattaaacgtctatataaattattagagatttggatagaatttggacgcatcaagctccttcaaggttatcatccaaatgacatagaaaaagagtgggggaaactcattattgccatgctagagagagagaaggcccttcgtccagaagtagaaaggttagaaatgttgcaacagattgccaacagagttcagagggacagtgtcatctgtgaagacaaactgattcttgctggaaatgctcttcagtctgattctaaaagattagaatcaggagtgcagtttcagaatgaagcagaaattgctgggtatatacttgaatgtgagaaccttttacgccagcatgtaattgatgtacagattcttattgatggaaaatactaccaggcagatcaattggtacagagggttgcaaaactgcgtgacgaaattatggccttaaggaacgaatgttcttctgtgtacagcaaaggacgcatactgacaacagaacagacaaagctcatgatatcaggaatcactcaaagtttaaactcaggatttgcacagaccttacaccctagtctgacctcagggctgacccagagtttaacaccttccctaacctcttctagtatgacttctggcctgtcatcagggatgacttcccgcctgactccatctgtcactccagcttatacacctggtttcccatcaggattagttccaaatttcagttcaggagtagagccaaattcattgcaaactttgaagttgatgcagatccgaaaaccccttctaaagtcttctttgctggatcaaaatttaacagaagaagaaatcaatatgaaatttgttcaggatcttttgaattgggttgatgagatgcaggtacaactggaccgcactgagtggggctcagatttgccaagtgttgaaagccatttagaaaatcataaaaatgttcatagagctattgaagaatttgaatctagtctcaaagaagctaaaatcagtgagattcaaatgacagcacctcttaaactgacttatgcagaaaagttgcacagattagagagtcagtatgcaaaactcttgaatacatccaggaatcaagaacggcaccttgatacactccataattttgtaagtcgtgcgactaatgaacttatttggttgaatgaaaaagaagaggaggaagttgcttatgactggagtgagagaaacaccaacatagctaggaaaaaagattatcatgctgaattaatgagagaacttgatcaaaaggaagaaaatattaaatcagttcaggagatagcagagcagctacttctagaaaatcatccagcccggttaactattgaggcctacagagcggcaatgcagacgcagtggagctggatcttacagctctgccagtgtgtggagcagcacataaaggagaacacagcgtatttcgagtttttcaatgatgccaaagaagctactgattacttaaggaatctaaaagatgccattcagcggaagtacagctgtgatagatcaagcagcattcacaagctagaagaccttgttcaggaatcaatggaagagaaagaagaacttctgcagtacaaaagcactatagcaaacctaatgggaaaagcaaaaacaataattcaactgaagccaaggaattctgactgtccactcaaaacttctattccgatcaaagctatctgtgactacagacaaattgagataaccatttacaaagacgatgaatgtgttttggcgaataactctcatcgtgctaaatggaaggtcattagtcctactgggaatgaggctatggtcccatctgtgtgcttcaccgttcctccaccaaacaaagaagcggtggaccttgccaacagaattgagcaacagtatcagaatgtcctgactctttggcatgagtctcacataaacatgaagagtgtagtatcctggcattatctcatcaatgaaattgatagaattcgagctagcaatgtggcttcaataaagacaatgctacctggtgaacatcagcaagttctaagtaatctacaatctcgttttgaagattttctggaagatagccaggaatcccaagtcttttcaggctcagatataacacaactggaaaaggaggttaatgtatgtaagcagtattatcaagaacttcttaaatctgcagaaagagaggagcaagaggaatcagtttataatctctacatctctgaagttcgaaacattagacttcggttagagaactgtgaagatcggctgattagacagattcgaactcccctggaaagagatgatttgcatgaaagtgtgttcagaatcacagaacaggagaaactaaagaaagagctggaacgacttaaagatgatttgggaacaatcacaaataagtgtgaggagtttttcagtcaagcagcagcctcttcatcagtccctaccctacgatcagagcttaatgtggtccttcagaacatgaaccaagtctattctatgtcttccacttacatagataagttgaaaactgttaacttggtgttaaaaaacactcaagctgcagaagccctcgtaaaactctatgaaactaaactgtgtgaagaagaagcagttatagctgacaagaataatattgagaatctaataagtactttaaagcaatggagatctgaagtagatgaaaagagacaggtattccatgccttagaggatgagttgcagaaagctaaagccatcagtgatgaaatgtttaaaacgtataaagaacgggaccttgattttgactggcacaaagaaaaagcagatcaattagttgaaaggtggcaaaatgttcatgtgcagattgacaacaggttacgggacttagagggcattggcaaatcactgaagtactacagagacacttaccatcctttagatgattggatccagcaggttgaaactactcagagaaagattcaggaaaatcagcctgaaaatagtaaaaccctagccacacagttgaatcaacagaagatgctggtgtccgaaatagaaatgaaacagagcaaaatggacgagtgtcaaaaatatgcagaacagtactcagctacagtgaaggactatgaattacaaacaatgacctaccgggccatggtagattcacaacaaaaatctccagtgaaacgccgaagaatgcagagttcagcagatctcattattcaagagttcatggacctaaggactcgatatactgccctggtcactctcatgacacaatatattaaatttgctggtgattcattgaagaggctggaagaggaggagaagtcactggaagaagaaaagaaagaacatgttgaaaaagccaaagaattgcaaaaatgggtatcaaatatcagcaagacattgaaagatgcagagaaggctggaaaacctcccttctctaagcaaaagatttccagtgaggaaatatcaaccaagaaggaacaattatcggaagcacttcaaactatacagctttttttggcaaaacatggagacaaaatgacagatgaagaaagaaatgaattggaaaaacaagtgaaaactcttcaggaaagttataatttattattcagtgaatctctgaaacagctacaagaatcacaaacctcaggagatgtaaaggtagaggagaagattgtagcagagcgtcagcaggagtataaagagaaactccaagggatatgtgatcttcttacccaaactgaaaaccgcctaattggtcaccaagaagccttcatgattggagatggcacagttgagttaaagaaatatcagtccaagcaagaggaattacagaaagatatgcaaggaagtgcacaggcattggctgaagtagtgaaaaacacagagaacttcttaaaagagaatggtgaaaagctgtcacaggaagataaggctttgattgaacagaaacttaatgaagctaagataaagtgtgaacagcttaatttaaaagcagaacagtctaaaaaggagctggataaagttgtgacaacagcaatcaaggaagaaactgaaaaggtagcagcagtgaagcagctggaagagagcaaaaccaaaatagaaaaccttttggactggttgtcaaatgttgacaaagactcagaaagggcagggacaaaacacaaacaggtaatcgaacagaacgggacccattttcaagaaggtgatggcaagtcagcaattggagaagaggatgaagttaatggtaacctgttggagactgatgttgatgggcaagttggaaccactcaggagaatctgaatcagcaatatcagaaagttaaggcccaacacgagaagatcatctctcagcaccaagcagtgatcatagccactcagtctgcacaagtgttgcttgagaaacagggtcagtatctctctcctgaagaaaaagagaaactgcaaaagaacatgaaggaactgaaagtgcattatgaaactgcactggctgagtcagagaagaaaatgaagttaactcactctctgcaggaagaattagaaaagtttgatgctgactataccgagtttgagcactggctacagcagtcagaacaagaacttgaaaacctggaggcaggtgcagatgacatcaatggtttaatgaccaaattgaagaggcagaagagtttctcagaagacgttatttctcacaaaggtgacttgagatacatcacaatttctggaaacagagtgttggaagctgccaaatcttgcagcaagagagacggtggcaaggttgatacttctgcaacccacagagaagtgcagcgcaagttggatcatgctactgatcggttcaggtctctctactctaagtgcaatgttcttggaaataatcttaaagatctggtggataaatatcaacactatgaagatgcttcatgtggacttcttgctggactccaggcctgtgaggccacagcgagcaaacacttatctgaacctattgcggtggaccccaaaaatcttcaaaggcaattagaagagaccaaggctttgcaaggacagatatcaagtcagcaggttgctgtagagaaactgaagaaaacggctgaagtgcttttagatgccaggggatctttacttccagccaagaatgatatccagaaaacacttgatgacattgttgggagatatgaggatctgtccaagtctgttaatgaacgaaatgaaaaactccagataaccttgacccgttcactgagtgtgcaggatggcttggatgaaatgctggactggatgggaaatgtggaaagttctctgaaagaacaaggtcaagtgcctttaaactctactgctcttcaggatattatcagtaaaaacattatgttggaacaggatattgcaggtcgtcagagcagtataaatgccatgaatgaaaaagtgaagaaatttatggaaacaacagatccatccactgcatcctcactgcaagccaaaatgaaagacttgtctgctcggttttcagaagcaagtcataaacacaaagaaactcttgccaaaatggaggagctaaaaaccaaagtagaactgtttgagaacctctcagaaaagctccagacatttttagaaacaaaaactcaggctcttactgaagtagatgtgccaggaaaagatgttactgaattgtctcagtatatgcaggaatcaacttctgaatttttagaacacaagaaacatcttgaagttttgcatagtctcttgaaggagatatccagccatggcttaccaagtgataaggctttggtccttgaaaaaacaaataatttgtcaaagaaattcaaggaaatggaggataccatcaaagaaaaaaaagaagctgtaacttcttgtcaagaacagttggatgctttccaagttcttgttaaatcattgaagtcatggataaaagaaacaacaaaaaaagttcccattgtacagccttcttttggtgcagaggatttaggaaaatctttggaagacactaagaaattacaagaaaagtggagtttaaaaacaccagagattcagaaagtaaacaacagtgggatctcactatgtaacttaataagtgctgtgaccacccctgcaaaggcaatagcagcagttaaatcaggtggagcagtattaaatggtgaaggaacagccacaaatactgaggaattttgggcaaataaaggtttaacatccattaaaaaggacatgactgacataagtcatggttatgaagatcttggcctcttactcaaggacaaaatagcggaactgaacactaaactctccaaattgcaaaaggctcaggaagaatcaagtgcaatgatgcagtggttacagaaaatgaacaaaactgcaacaaaatggcagcagacacctgcacctacagatactgaagctgtgaagactcaagttgagcagaataagtcgtttgaggcagaactgaagcagaatgtaaacaaagtacaggagttgaaagacaaattgacagagctgttggaggagaacccagatactcctgaggcccccagatggaaacagatgttgacagaaatagattctaagtggcaagaactcaatcaattaacaattgatagacaacaaaaactggaagaatcctccaataatctaacccagttccagactgtagaggcccaattgaaacagtggcttgtggaaaaagaacttatggtcagtgttcttgggcccttgtcaattgacccaaatatgctaaacacacaaaggcagcaggtgcagattttgctgcaagaattcgccactcggaaacctcaatatgaacagctgacagcagctggtcagggcattctgagcaggcctggagaagacccttctttacgtgggattgtgaaagagcaactggcagctgtgacccaaaaatgggatagcctaacagggcaattgagtgacagatgtgactggattgaccaagccattgttaaaagcacacagtatcaaagcctgctgagaagcctttctgataaactgagtgacttggataataaactcagcagcagtctggctgtgagcacgcaccctgatgctatgaaccaacagttggaaacagcccaaaaaatgaagcaggagatacagcaggaaaagaagcagataaaagtggcccaggcactctgtgaggatttgtcagcactggttaaagaagagtacttgaaagcagaacttagtaggcaactagaaggcatcttaaaatcatttaaggatgttgaacagaaagcagagaatcatgtccagcaccttcagtcggcctgtgcaagctctcatcaatttcagcaaatgtctagagattttcaggcttggctggatacaaagaaagaagagcaaaacaaatctcatccaatatctgccaaactcgatgtcttggagtcattaattaaagatcataaagactttagtaaaactttgaccgctcagtctcatatgtatgaaaaaaccattgcagaaggtgaaaatctgttattaaaaacacaagggtctgagaaggcagccttacagttacagcttaatacaattaaaaccaattgggatacatttaataagcaggtgaaagaaagagaaaacaagttaaaagagtcattggaaaaagcccttaagtataaagagcaagtagagactctctggccatggatagacaaatgccaaaacaacctggaggaaataaaattttgcttggatcctgctgaaggagagaattctattgccaagttaaagtctctgcagaaggaaatggaccaacactttggtatggtagaattactgaacaacacagccaatagcttgctcagtgtctgtgagatagataaagaagttgttacagatgagaataagtcactgatccagaaggtggacatggtcactgaacaacttcacagtaagaaattctgtctggagaacatgactcagaagtttaaagaatttcaagaagtttccaaagaatctaaaaggcagcttcagtgtgcaaaggagcagctagatatccatgattcgctgggatcccaggcttacagtaacaaatacctgaccatgttgcaaactcagcagaaatcacttcaggccttgaagcatcaggtagatttggctaaaagacttgcacaggaccttgtggtagaggcctcagactcaaagggaacctctgatgttttattacaagtggaaaccatagctcaagagcatagtacactaagtcagcaggttgatgaaaagtgttctttcttagaaaccaagcttcagggcattgggcatttccagaataccattcgagaaatgttttctcagttcgcagagtttgatgatgaactggatagcatggctccagtggggagagatgcagaaacattgcaaaagcaaaaggaaactataaaagcctttctaaagaaactagaagccctcatggcaagcaatgacaatgccaataaaacctgcaagatgatgttagccacagaagaaacctctcctgaccttgttggaatcaaaagggacttggaggccttaagcaaacaatgcaacaagttactggaccgagcccaagccagagaagagcaggttgaagggacaattaagcgccttgaagaattttacagcaaattgaaagaattttctattctgctccagaaagccgaagaacatgaagagtcacaaggtcctgttggtatggaaacggagacaattaatcagcagcttaacatgttcaaggtattccagaaagaagagattgaacccttgcaaggtaaacagcaagatgtaaactggttaggtcaaggccttattcagagtgctgccaaaagcactagcactcagggcttggagcatgacctggatgatgtcaatgcacggtggaagactctcaataagaaggtggctcagcgagcagcccagctgcaggaggccttgctgcactgtgggaggttccaggatgccctggagtccctgctcagctggatggtggacactgaggagcttgtggccaatcagaagcccccgtcggctgagttcaaagtggtaaaggcccagatacaagaacaaaagcttctccagagattgttggatgaccgaaaatctacggtggaggtaatcaaacgagaaggagaaaaaattgctacaacagcagagcccgcagataaagtgaagattttgaaacagctcagtctcttggatagcagatgggaggcattgcttaataaagctgaaacaaggaatcgtcagttggaaggtatctcggtggtagcacagcaatttcatgaaaccttagaaccactgaacgagtggcttacaaccatagaaaagaggctggtgaattgtgaacccataggaacccaagcatctaaacttgaggaacaaattgcacagcacaaagccttagaagatgacatcatcaatcacaataaacatttacaccaggctgttagcattggccagtccttaaaggttttgagctccagggaggataaagatatggtgcagagtaaattagacttctctcaagtatggtacattgagattcaagagaaaagtcacagcaggtctgagctcctccagcaggccttatgtaatgctaagatttttggggaagatgaagttgaactgatgaactggctgaatgaagtgcatgacaaactgagcaagctctcagtccaggattacagcactgaggggctatggaagcagcagtctgaacttcgggttctgcaagaggacatcttactcaggaaacaaaatgtagatcaggctttactaaatggtttagaactacttaaacaaaccacaggtgatgaagttttaataattcaagataaattggaagccattaaagcaaggtacaaagacattactaaactgagcactgatgtggccaagactctggaacaggcgctgcagcttgcaaggcggctgcactccacacacgaagagctgtgtacctggctggacaaagtggaggtggaattactttcatatgaaactcaggttctgaaaggagaagaagcaagtcaagcacaaatgagaccaaaggaactgaaaaaggaagctaagaacaacaaagccttactggactcccttaatgaagtgagcagtgctttgctggaactggtaccatggagggcaagagaaggacttgagaaaatggtagctgaggacaatgagcgctaccgattagtgagcgacaccatcactcagaaggtggaggagatcgatgcagccattctgcgatcacagcagtttgaccaagcagctgatgctgagttatcctggattactgaaacagaaaaaaaattgatgtctctgggtgacatcaggcttgagcaagaccagacttctgctcagcttcaagttcaaaagacattcaccatggagattttgagacacaaggatattattgatgaccttgttaaatctgggcataaaatcatgaccgcatgcagtgaagaggaaaagcaatcaatgaagaaaaaactggacaaggtactgaagaactatgataccatctgccagattaattcagaaaggtatctgcagctggaacgggcacagtccctggttaaccaattctgggaaacatatgaagaactttggccatggctgacagaaacacaatcaatcatctctcagcttcccgccccagcccttgaatatgaaactctaaggcagcagcaggaagaacatcggcaactgcgtgagttgatagctgaacacaagcctcatatagataagatgaacaaaactgggccacagttactggaattgagccctggggaaggcttttctatccaagagaagtatgtggcagccgacaccctttacagtcaaattaaagaagatgtcaaaaagcgtgctgtggcactggatgaagccatttctcaatcaactcagttccatgacaagatagatcagatccttgagagcctggaacgcatcgtggaacgtctgaggcagccaccctctatctctgcagaggttgagaagatcaaggaacagatcagtgaaaataagaatgtgtcagtagacatggaaaagctacagccgttgtatgaaactcttaaacagaggggagaggaaatgattgctagatctggggggactgataaagacatatctgccaaagctgttcaggataagcttgaccaaatggttttcatttgggagaacatacacacactggtggaagagagggaagccaaactactggatgtgatggagctagcagaaaagttctggtgtgatcacatgtcattgatagttaccattaaagatactcaagatttcatccgggacctggaagatcctggaattgatccttcagtagtaaaacaacagcaagaagcagcagagaccataagggaagaaatagatggactacaggaggagctggatatagttattaacctaggttctgaactcattgcggcatgtggggagcctgataaacccattgtcaagaagagtatagatgagttaaattcagcatgggattctctaaataaagcttggaaagaccggattgacaaacttgaggaggcaatgcaggctgccgttcagtaccaggatggactgcaggcggtatttgactgggtagatattgcaggtggtaaattagcttcaatgtctccaattggaacagatctcgaaactgtcaagcagcagattgaagagctaaagcaatttaagtctgaggcctatcaacagcagatagaaatggaaagactgaatcatcaagcagagcttttgctaaagaaagtaacagaagagagtgacaaacacactgttcaagacccattaatggaactgaaattgatatgggatagcctggaggagagaatcatcaacagacagcataaactggagggtgctctattagccttgggtcagttccaacatgccctggatgagctcctggcatggctgacacacaccgagggcttgctaagtgagcagaaacctgttggaggagaccctaaagccattgaaattgaacttgccaagcatcatgtgctccaaaatgatgtattagcccatcagtccacagtggaagccgttaataaagcaggaaatgatctaattgaatcaagtgcaggagaagaagcaagcaaccttcagaacaagctagaggttttaaatcaacgctggcaaaatgttttggaaaaaacagaacaaaggaagcagcagctggatggtgccttgcgccaggccaaagggttccatggcgaaattgaggatttgcagcagtggctgactgacacggagcgtcatctgttggcatctaaaccgctgggaggtttaccggaaacagccaaggagcagcttaatgtccatatggaagtctgtgctgcctttgaagctaaagaagaaacatataagagtctgatgcagaaaggccagcagatgcttgcaagatgcccaaaatctgcagagacaaatattgaccaagacataaataacttgaaagaaaaatgggaatcggtggaaaccaaactcaatgaaaggaaaactaaactggaagaggctctcaacttggcaatggagttccacaattctctccaagacttcatcaactggcttactcaggctgaacagaccctaaatgtagcttctcggccaagtctcatcttggacacagtcttatttcaaattgacgaacacaaggtttttgccaatgaagtaaattctcatcgtgagcagataatagagctggacaaaactggaacccacctaaaatattttagtcagaaacaagatgttgttctaatcaagaatctacttatcagtgtacaaagtcgatgggaaaaagtggttcaacggttggtagagagaggaagatctttggatgatgcaaggaagagagccaagcagttccatgaagcttggagtaaacttatggagtggctagaagagtcagaaaagtctttggattctgaactggaaatcgcaaatgatccagacaaaataaaaacacaacttgcacaacataaggagtttcagaaatcactcggagccaagcattctgtctacgacaccaccaacaggactggacgttctctgaaggagaaaacctccctggctgatgacaacctgaaactggatgacatgctgagtgaactcagagacaaatgggataccatatgtggaaaatctgtggaaagacaaaacaaattggaggaagccctgttattttctggacaattcacagatgccctacaggctctcattgattggttatatagagttgaaccccagctggcagaagaccagcctgttcatggagacattgatttggtgatgaatctgatcgataatcacaaggccttccaaaaagagttggggaagaggaccagcagtgtgcaggccctgaagcgctcagcccgagaactcatagaaggcagtcgggatgactcctcctgggtcaaggtccagatgcaggaattaagcacacgctgggagaccgtgtgtgcactttctatatcaaagcaaacacggttagaagcagccctgcgtcaggcagaggaattccactcggtggtacatgccctcttggagtggctggctgaggcggagcaaaccctgcgtttccatggtgtcctcccagatgatgaggatgctctccggactctcattgatcagcataaagaattcatgaagaaactggaagaaaagagagctgaactaaataaagccaccactatgggcgacaccgttttggctatctgccaccccgactccatcactaccattaagcactggataacaatcatccgggcgaggtttgaggaggtgctggcctgggcaaagcaacatcagcagagattagcaagtgctctgg

SEQ ID NO: 5661 - DNA, 2764 bp, Homo sapiens
agctctcagagggaattgagcacccggcagcggtctcaggccaagccccctgccagcatggccagcgagttcaagaagaagctcttctggagggcagtggtggccgagttcctggccacgaccctctttgtcttcatcagcatcggttctgccctgggcttcaaatacccggtggggaacaaccagacggcggtccaggacaacgtgaaggtgtcgctggccttcgggctgagcatcgccacgctggcgcagagtgtgggccacatcagcggcgcccacctcaacccggctgtcacactggggctgctgctcagctgccagatcagcatcttccgtgccctcatgtacatcatcgcccagtgcgtgggggccatcgtcgccaccgccatcctctcaggcatcacctcctccctgactgggaactcgcttggccgcaatgacctggctgatggtgtgaactcgggccagggcctgggcatcgagatcatcgggaccctccagctggtgctatgcgtgctggctactaccgaccggaggcgccgtgaccttggtggctcagccccccttgccatcggcctctctgtagcccttggacacctcctggctattgactacactggctgtgggattaaccctgctcggtcctttggctccgcggtgatcacacacaacttcagcaaccactggattttctgggtggggccattcatcgggggagccctggctgtactcatctacgacttcatcctggccccacgcagcagtgacctcacagaccgcgtgaaggtgtggaccagcggccaggtggaggagtatgacctggatgccgacgacatcaactccagggtggagatgaagcccaaatagaaggggtctggcccgggcatccacgtagggggcaggggcaggggcgggcggagggaggggaggggtgaaatccatactgtagacactctgacaagctggccaaagtcacttccccaagatctgccagacctgcatggtcaagcctcttatgggggtgtttctatctctttctttctctttctgtttcctggcctcagagcttcctggggaccaagatttaccaattcacccactcccttgaagttgtggaggaggtgaaagaaagggacccacctgctagtcgcccctcagagcatgatgggaggtgtgccagaaagtcccccctcgccccaaagttgctcaccgactcacctgcgcaagtgcctgggattctaccgtaattgctttgtgcctttgggcacggccctccttcttttcctaacatgcaccttgctcccaatggtgcttggagggggaagagatcccaggaggtgcagtggagggggcaagctttgctccttcagttctgcttgctcccaagcccctgacccgctcggacttactgcctgaccttggaatcgtccctatatcagggcctgagtgacctccttctgcaaagtggcagggaccggcagagctctacaggcctgcagcccctaagtgcaaacacagcatgggtccagaagacgtggtctagaccagggctgctctttccacttgccctgtgttctttccccaggggcatgactgtcgccacacgcctctgtgtacatgtgtgcagagcagacaggctacaaagcagagatcgacagacagccaggtagttggaactttctgttccctatggagaggcttccctacacagggcctgctattgcagaatgaagccatttagagggtgaaggagaaatacccatgttacttctctgagttttagttggtctttccatctatcactgcattatcttgctcattcttcagttctctactccctcttgtcagtgtagacacaggtcaccattatgctggtgtatgtttatcaaagagcacttgagctgtctgaagcccaaagcctgaggacagaaagaccctgatgcaggtcagcccatggaggcagatgcccttgctgggcctgggggttttccaagccctcagctggtcctgaccaggatggagcaagctcttcccttgctcatgagctcctgatcagaggcatttgagcagctgaataacctgcacaggcttgctgtatgacccctggccacagccttccctctgcattgacctggaggggagaggtcagccttgacctaatgaggtagctatagttgcagcccaaggacagttcagagatcaggatcagctttgaaggctggattctatctacataagtcctttcaattccaccagggccagagcagctccaccactgtgcacttagccatgatggcaacagaaaccaagagacacaattacgcaggtatttagaagcagagggacaaccagaaggcccttaactatcaccagtgcatcacatctgcacactctcttctccattccctagcaggaacttctagctcatttaacagataaagaaactgaggcccacggtttcagctagacaatgatttggccaggcctagtaaccaaggccctgtctctggctactccctggaccacgaggctgattcctctcatttccagcttctcagtttctgcctgggcaatggccaggggccaggagtggggagagttgtgatggaggggagaggggtcacacccaccccctgcctggttctaggctgctgcacaccaaggccctgcatctgtctgctctgcatatatgtctctttggagttggaatttcattatatgttaagaaaataaaggaaaatgacttgtaaggtcaaaaaaaaaa

SEQ ID NO: 5662 - DNA, 4364 bp, Homo sapiens
agatgacaatagggagaatggagaacgtggaggtcttcaccgctgagggcaaaggaaggggtctgaaggccaccaaggagttctgggctgcagatatcatctttgctgagcgggcttattccgcagtggtttttgacagccttgttaattttgtgtgccacacctgcttcaagaggcaggagaagctccatcgctgtgggcagtgcaagtttgcccattactgcgaccgcacctgccagaaggatgcttggctgaaccacaagaatgaatgttcggccatcaagagatatgggaaggtgcccaatgagaacatcaggctggcggcgcgcatcatgtggcgggtggagagagaaggcaccgggctcacggagggctgcctggtgtccgtggacgacttgcagaaccacgtggagcactttggggaggaggagcagaaggacctgcgggtggacgtggacacattcttgcagtactggccgccgcagagccagcagttcagcatgcagtacatctcgcacatcttcggagtgattaactgcaacggttttactctcagtgatcagagaggcctgcaggccgtgggcgtaggcatcttccccaacctgggcctggtgaaccatgactgttggcccaactgtactgtcatatttaacaatggcaatcatgaggcagtgaaatccatgtttcatacccagatgagaattgagctccgggccctaggcaagatctcagaaggagaggagctgactgtgtcctatattgacttcctcaacgttagtgaagaacgcaagaggcagctgaagaagcagtactactttgactgcacatgtgaacactgccagaaaaaactgaaggatgacctcttcctgggggtgaaagacaaccccaagccctctcaggaagtggtgaaggagatgatacaattctccaaggatacattggaaaagatagacaaggctcgttccgagggtttgtatcatgaggttgtgaaattatgccgggagtgcctggagaagcaggagccagtgtttgctgacaccaacatctacatgctgcggatgctgagcattgtttcggaggtcctttcctacctccaggcctttgaggaggcctcgttctatgccaggaggatggtggacggctatatgaagctctaccaccccaacaatgcccaactgggcatggccgtgatgcgggcagggctgaccaactggcatgctggtaacattgaggtggggcacgggatgatctgcaaagcctatgccattctcctggtgacacacggaccctcccaccccatcactaaggacttagaggccatgcgggtgcagacggagatggagctacgcatgttccgccagaacgaattcatgtactacaagatgcgcgaggctgccctgaacaaccagcccatgcaggtcatggccgagcccagcaatgagccatccccagctctgttccacaagaagcaatgaggactgcccagtggaggaggggcgatgtggctggggagctagggagagactctggaggtggtgggtctctcgggagacccctaatgaggaagttgaggtaatgcttaacattgttgctgtgagaatttactgccctatgtttcccagagccattttggctcaattcaagtctattcaattcaagttaactctagcccagcccagatcaactcctcctacaaatattattggatgataggccctagaacccaataaaggagctccaaatgtcgttgggtggggaagcaaaatgtagagaaacatttaaagcacactgtaataataaatgcaattataaactatatggaggagggtgcaggggagggaatgtgtctggtgtgtgatgtgtgtatgtgcagtgggggtatcacagagagtatgacatctgagttaagggtagcaggtgcctggagtctcaggtggctgctcacccatctgtgcaggtgtctctggggctgctggtctcacctgtggtctgcagtagacacaattggctgagcaggatatgtgatactgtgtggttggtgtggagttttgaagaaggggctgtgtttgggccacgtaggctctactcagagacctgaaaccacttcagaatggcgcatatgtcgaaagagctggctgggggccttgcccaaaccaactgaggtcttaaagtccagggaaaaaaagtctgggttccaactagaattctagaaatatttctagaacacacagagagggaataagtccctctatcacccttattaccaagccttgtggttccctgtgattttagacaatgtctgatatttttctggctatttgcctagtaggatttaaaaaatattttcaaagtgaagctgagagagaatcttggaaacacacatacctgttgatcatgggccctgcagaattggcccttgggggctttatttggttacatgtgcctgggtggtctttaccagcttagactctaccatgggcccccatgaagctccattctcaatactgaataattattacttcccttgttgagtttctttttctgtcatgccctgggggcttctgctcttctcaccagaaagaacatttgaatctggattcttgtacacctgggttagaccctgttcagaggtgtggccaatttatcccgatctcctggaaggctgttgtgatttccatctaagaaatgagggtcttgagaatcaaccagtcccaagattagcctgttatcctgttatctactgagaccccaaatttctcaccaatgttttgggagatcctggaaaagatcccttcagtttagggtgtcaccaagacttctacacaacccaggactaccattgacctcagagctgtaccccacatcttgaagtaaattgatcccaccaggtcccacgtttgttatctctgcctaaatgttagcttctccatcctcaccacatgatgacctgctgtgtccctctgagcactacccagtggctgaaaactctgcaaatgggccacacttttgcaaaatacttgtatctgacacttaggtcttgtttgaagaatttcctttctggaaggttttacaagaagactgatagtctttcaagcccccacatcacaggcttagggacggcactaactttctcccagggatctaactggctagttcaaattatcactcttttaccttcatataaaatgtctcccccaaacctttttcccttctttgtcattgttatctgctaagcccctggtcatttccccatattcgtagtctttttttccatcctatctttctaatatttgttgtctttaacaaactgtgttctgtgtctgtgctcctccttccctctcagaccactggaatgcaagtccttcttccctttggaatgtactctggatcccttcccctgctttgacccccagactttgctccatctattattgcttctccatcctggatccttgacatttgtcaccccactggccttctcaggtgcaatcagtaaaaatgctgagaactcttggatcttaatcttcatgactgagttttttttagttgtatagttatcatctgcctttcttcactttgcatttcttcttgaatccattgcagattgacttccactcccactccttcactaaaaggactcttaccaagatcaaatctaatgggtacattttagttcctatgtgatttggcctttcgatgtcaatcatcactcccagccattgattttggtgacccacttccctgtgatgatcttctgatctagtttctcaggttccttcgctggtcctttttctttccctgcccctgacatattgacatttcctggagttggttttgtccttgattcattctcatgtcattctgcacacagtctctgcatgaactcaggcagacccttcatttaatgaccaccttagggctgatgattctcaaatctgtattccccgatcttgcatttgagctccagccccactcatcctctcggatgttctgcaggcccagcaaactcatcatgtccaaagtgaaactttttctctttcctgtctcctctcctctgatctgttctttcttggaacaccacccaagaacgtcacctcctccatcagattgtgagctcctggagggcaggagctgtgtccttctattcatcttcctatccccagaaccttgcacagatcctggaatgtggtaggtgctcagtaaatgtgtgttgaataaatgaatgaatgaatgaacaaatgaatgaatttgcttacttcaaggcaaaagaaccatgaaactgtattttgagtttctatgttatagcagtcagcaaatcctattaaatactttgtgtttccaagcaaaaaaaaaaaaaaaaaaaa

SEQ ID NO: 5663 - DNA, 2231 bp, Homo sapiens
acaaggcagcctcgctcgagcgcaggccaatcggctttctagctagagggtttaactcctatttaaaaagaagaacctttgaattctaacggctgagctcttggaagacttgggtccttgggtcgcagggtctcactccattgcccaggccagagtgcggggatatttgataagaaacttcagtgaaggccgggcgcggtggctcatgcccgtaatcccagcattttcggaggccgaggcatcatggaccgatctaaagaaaactgcatttcaggacctgttaaggctacagctccagttggaggtccaaaacgtgttctcgtgactcagcaatttccttgtcagaatccattacctgtaaatagtggccaggctcagcgggtcttgtgtccttcaaattcttcccagcgcattcctttgcaagcacaaaagcttgtctccagtcacaagccggttcagaatcagaagcagaagcaattgcaggcaaccagtgtacctcatcctgtctccaggccactgaataacacccaaaagagcaagcagcccctgccatcggcacctgaaaataatcctgaggaggaactggcatcaaaacagaaaaatgaagaatcaaaaaagaggcagtgggctttggaagactttgaaattggtcgccctctgggtaaaggaaagtttggtaatgtttatttggcaagagaaaagcaaagcaagtttattctggctcttaaagtgttatttaaagctcagctggagaaagccggagtggagcatcagctcagaagagaagtagaaatacagtcccaccttcggcatcctaatattcttagactgtatggttatttccatgatgctaccagagtctacctaattctggaatatgcaccacttggaacagtttatagagaacttcagaaactttcaaagtttgatgagcagagaactgctacttatataacagaattggcaaatgccctgtcttactgtcattcgaagagagttattcatagagacattaagccagagaacttacttcttggatcagctggagagcttaaaattgcagattttgggtggtcagtacatgctccatcttccaggaggaccactctctgtggcaccctggactacctgccccctgaaatgattgaaggtcggatgcatgatgagaaggtggatctctggagccttggagttctttgctatgaatttttagttgggaagcctccttttgaggcaaacacataccaagagacctacaaaagaatatcacgggttgaattcacattccctgactttgtaacagagggagccagggacctcatttcaagactgttgaagcataatcccagccagaggccaatgctcagagaagtacttgaacacccctggatcacagcaaattcatcaaaaccatcaaattgccaaaacaaagaatcagctagcaaacagtcttaggaatcgtgcagggggagaaatccttgagccagggctgccatataacctgacaggaacatgctactgaagtttattttaccattgactgctgccctcaatctagaacgctacacaagaaatatttgttttactcagcaggtgtgccttaacctccctattcagaaagctccacatcaataaacatgacactctgaagtgaaagtagccacgagaattgtgctacttatactggttcataatctggaggcaaggttcgactgcagccgccccgtcagcctgtgctaggcatggtgtcttcacaggaggcaaatccagagcctggctgtggggaaagtgaccactctgccctgaccccgatcagttaaggagctgtgcaataaccttcctagtacctgagtgagtgtgtaacttattgggttggcgaagcctggtaaagctgttggaatgagtatgtgattctttttaagtatgaaaataaagatatatgtacagacttgtattttttctctggtggcattcctttaggaatgctgtgtgtctgtccggcaccccggtaggcctgattgggtttctagtcctccttaaccacttatctcccatatgagagtgtgaaaaataggaacacgtgctctacctccatttagggatttgcttgggatacagaagaggccatgtgtctcagagctgttaagggcttatttttttaaaacattggagtcatagcatgtgtgtaaactttaaatatgcaaataaataagtatctatgtctaaaaaaa

SEQ ID NO: 5664 - DNA, 1331 bp, Homo sapiens
cctgcatctttttggaaggattctttttataaatcagaaagtgttcgaggttcaaaggtttgcctcggagcgtgtgaacattcctccgctcggttttcaactcgcctccaacctgcgccgcccggccagcatgtctccccgcccgtgaagcggggctgccgcctccctgccgctccggctgccactaacgacccgccctcgccgccacctggccctcctgatcgacgacacacgcacttgaaacttgttctcagggtgtgtggaatcaactttccggaagcaaccagcccaccagaggaggtcccgagcgcgagcggagacgatgcagcggagactggttcagcagtggagcgtcgcggtgttcctgctgagctacgcggtgccctcctgcgggcgctcggtggagggtctcagccgccgcctcaaaagagctgtgtctgaacatcagctcctccatgacaaggggaagtccatccaagatttacggcgacgattcttccttcaccatctgatcgcagaaatccacacagctgaaatcagagctacctcggaggtgtcccctaactccaagccctctcccaacacaaagaaccaccccgtccgatttgggtctgatgatgagggcagatacctaactcaggaaactaacaaggtggagacgtacaaagagcagccgctcaagacacctgggaagaaaaagaaaggcaagcccgggaaacgcaaggagcaggaaaagaaaaaacggcgaactcgctctgcctggttagactctggagtgactgggagtgggctagaaggggaccacctgtctgacacctccacaacgtcgctggagctcgattcacggaggcattgaaattttcagcagagaccttccaaggacatattgcaggattctgtaatagtgaacatatggaaagtattagaaatatttattgtctgtaaatactgtaaatgcattggaataaaactgtctcccccattgctctatgaaactgcacattggtcattgtgaatattttttttttgccaaggctaatccaattattattatcacatttaccataatttattttgtccattgatgtatttattttgtaaatgtatcttggtgctgctgaatttctatattttttgtaacataatgcactttagatatacatatcaagtatgttgataaatgacacaatgaagtgtctctattttgtggttgattttaatgaatgcctaaatataattatccaaattgattttcctttgtgcatgtaaaaataacagtattttaaatttgtaaagaatgtctaataaaatataatctaattacatcatga

SEQ ID NO: 5665 - DNA, 569 bp, Homo sapiens
aggctcagtataaatagcagccaccgctccctggcaggcagggacccgcagctcagctacagcacagatcagcaccatgaagcttctcacgggcctggttttctgctccttggtcctgggtgtcagcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgcctgggctgcagaagtgatcagcgatgccagagagaatatccagagattctttggccatggtgcggaggactcgctggctgatcaggctgccaatgaatggggcaggagtggcaaagaccccaatcacttccgacctgctggcctgcctgagaaatactgagcttcctcttcactctgctctcaggagatctggctgtgaggccctcagggcagggatacaaagcggggagagggtacacaatgggtatctaataaatacttaagaggtggaatttgtggaaact

SEQ ID NO: 5666 - DNA, 1550 bp, Homo sapiens
cagggctgcgactggccggctccagcgggcggggcggcgagcgagtgctcgcggccacgtgaccgacgccaacatggcggcgcccagtggcgtccacctgctcgtccgcagaggttctcatagaattttctcttcaccactcaatcatatctacttacacaagcagtcaagcagtcaacaaagaagaaatttcttttttcggagacaaagagatatttcacacagtatagttttgccggctgcagtttcttcagctcatccggttcctaagcacataaagaagccagactatgtgacgacaggcattgtaccagactggggagacagcatagaagttaagaatgaagatcagattcaagggcttcatcaggcttgtcagctggcccgccacgtcctcctcttggctgggaagagtttaaaggttgacatgacaactgaagagatagatgctcttgttcatcgggaaatcatcagtcataatgcctatccctcacctctaggctatggaggttttccaaaatctgtttgtacctctgtaaacaacgtgctctgtcatggtattcctgacagtcgacctcttcaggatggagatattatcaacattgatgtcacagtctattacaatggctaccatggagacacctctgaaacatttttggtgggcaatgtggacgaatgtggtaaaaagttagtggaggttgccaggaggtgtagagatgaagcaattgcagcttgcagagcaggggctcccttctctgtaattggaaacacaatcagccacataactcatcagaatggttttcaagtctgtccacattttgtgggacatggaataggatcttactttcatggacatccagaaatttggcatcatgcaaacgacagtgatctacccatggaggagggcatggcattcactatagagccaatcatcacggagggatcccctgaatttaaagtcctggaggatgcatggactgtggtctccctagacaatcaaaggtcggcgcagttcgagcacacggttctgatcacgtcgaggggcgcgcagatcctgaccaaactaccccatgaggcctgaggagccgcccgaaggtcgcggtgacctggtgcctttttaaataaattgctgaaatttggctggagaacttttagaagaaacagggaaatgaccggtggtgcggtaacctgcgtggctcctgatagcgtttggaagaacgcgggggagactgaagagcaactgggaactcggatctgaagccctgctggggtcgcgcggctttggaaaaacaaatcctggccctggactcggtttcccagcgcggtcaacgcatctggaggggactggaggaaacccccttgttggaagagattccaagagaagcacggttttctctttcccttgccctgactgttggagtaaaaaacctcttaaatccattgtatcagaggtccttacctctctgacagttacagtgatctttgtatctgaactttgcacgtctgccgaaaaatccgaacctgttgactgggaaaaaaaaaaaaaaaaa

SEQ ID NO: 5667 - DNA, 1989 bp, Homo sapiens
ggcacagagaaccctgcttcaaagcagaagtagcagttccggagtccagctggctaaaactcatcccagaggataatggcaacccatgccttagaaatcgctgggctgtttcttggtggtgttggaatggtgggcacagtggctgtcactgtcatgcctcagtggagagtgtcggccttcattgaaaacaacatcgtggtttttgaaaacttctgggaaggactgtggatgaattgcgtgaggcaggctaacatcaggatgcagtgcaaaatctatgattccctgctggctctttctccggacctacaggcagccagaggactgatgtgtgctgcttccgtgatgtccttcttggctttcatgatggccatccttggcatgaaatgcaccaggtgcacgggggacaatgagaaggtgaaggctcacattctgctgacggctggaatcatcttcatcatcacgggcatggtggtgctcatccctgtgagctgggttgccaatgccatcatcagagatttctataactcaatagtgaatgttgcccaaaaacgtgagcttggagaagctctctacttaggatggaccacggcactggtgctgattgttggaggagctctgttctgctgcgttttttgttgcaacgaaaagagcagtagctacagatactcgataccttcccatcgcacaacccaaaaaagttatcacaccggaaagaagtcaccgagcgtctactccagaagtcagtatgtgtagttgtgtatgtttttttaactttactataaagccatgcaaatgacaaaaatctatattactttctcaaaatggaccccaaagaaactttgatttactgttcttaactgcctaatcttaattacaggaactgtgcatcagctatttatgattctataagctatttcagcagaatgagatattaaacccaatgctttgattgttctagaaagtatagtaatttgttttctaaggtggttcaagcatctactctttttatcatttacttcaaaatgacattgctaaagactgcattattttactactgtaatttctccacgacatagcattatgtacatagatgagtgtaacatttatatctcacatagagacatgcttatatggttttatttaaaatgaaatgccagtccattacactgaataaatagaactcaactattgcttttcagggaaatcatggatagggttgaagaaggttactattaattgtttaaaaacagcttagggattaatgtcctccatttataatgaagattaaaatgaaggctttaatcagcattgtaaaggaaattgaatggctttctgatatgctgttttttagcctaggagttagaaatcctaacttctttatcctcttctcccagaggctttttttttcttgtgtattaaattaacatttttaaaaagcagatattttgtcaaggggctttgcattcaaactgcttttccagggctatactcagaagaaagataaaagtgtgatctaagaaaaagtgatggttttaggaaagtgaaaatatttttgtttttgtatttgaagaagaatgatgcattttgacaagaaatcatatatgtatggatatattttaataagtatttgagtacagactttgaggtttcatcaatataaataaaagagcagaaaaatatgtcttggttttcatttgcttaccaaaaaaacaacaacaaaaaaagttgtcctttgagaacttcacctgctcctatgtgggtacctgagtcaaaattgtcatttttgttctgtgaaaaataaatttccttcttgtaccatttctgtttagttttactaaaatctgtaaatactgtatttttctgtttattccaaatttgatgaaactgacaatccaatttgaaagtttgtgtcgacgtctgtctagcttaaatgaatgtgttctatttgctttatacatttatattaataaattgtacatttttctaatt

SEQ ID NO: 5668 - DNA, 4323 bp, Homo sapiens
acagggagtggctcaggtttcttgacacttccctgctgtggcgaaaaggagaaataattaacagctcctggggctctaggatcgctgatcgcgtcgggggcactgcaagcgcccagctgagccatgctctgggaggagacaggcgccgcccctgcgcccgcgcgggcctcggacctcccctacaggatatcctcagaccatctcaaaaaggaggaaaagatgactatgatggctcaccagtacccctcttggatcttcattaatgagaagacattcataaccagggaacaacttaattctttattgaagacctataacattttttatgagaaccagaaaaatctgcatattttatatggagagactgaagatggcaaactaattgttgaaggaatgctggacattttctggggagtaaaacgacctatacagctaaaaatacaagatgagaagccattctcttcttttactagtatgaagtcatcagacgtcttctccagcaaaggaatgacacgctggggggaatttgacgatctctatcgtattagtgagctggacaggacccagattcctatgtctgaaaaaaggaattcccaggaagactatttatcttatcacagcaacaccctgaagccacatgcaaaggatgaaccagactccccagtgctctatagaaccatgagtgaagcagctctggtgagaaaaaggatgaagcctctgatgatggacagaaaagaaagacagaaaaatagagcctctattaatggacacttctataaccatgaaacatcaattttcattccagcctttgaatcagaaactaaggtcagagtaaacagtaacatgagaactgaagaagtaataaagcaacttctccaaaaatttaagattgaaaatagtccccaggattttgctcttcacattatttttgcaacaggagaacaaagacgactaaagaagacagacattccgctactgcagaggctcctacagggaccttctgaaaagaatgctcgcattttcctcatggataaagatgcagaagaaattagcagtgatgtggctcagtacattaactttcacttttctctcttggaatccattcttcaaagattaaatgaagaagagaaaagagagattcaaagaatagtaacaaaattcaataaagaaaaggcgattatactgaaatgtcttcaaaataaactagtaataaaaacagagacaacagtttagcagtacaagcttctattgctaaaacatttcaaaaaactcagagatattactctttgatgaatgcataagttctgtacttgcatttatacgaacatatatgagacttgaatcgtagaaaattgaatgtcaaaaaaagctcatttctttttgaagtgatgaggttaattagggttcacagttggacaaaatgagtttgagtttagtttcagtaactgaaataagcttgaatactgcatatgccaaatagcttttatagtaaaccatgtaatgaactcaaatttaaatggtgtcttcagataagcagtttaaacttcatttagcttggactctcaagagaactgaaacataatcaatggattcagaaatgactcagaaaaaagaagctgccagttcttggaatgaaaaagaaatacagtcttacaccatcaaggaatctacctgatagtgacagtagcttcttgaaaactctggcattttcataaaatctaggactatcttaaatggcctgttgacttctgactatctgtaacatcagagctgtctggcctttggaaaggaaaaattatggactctgttaagaaatcctaattgaaattttctgaacctccccccagcccttttattctctctcttctgctgatgaaagacctttcatcagttcaaagcttttcttaagctcttttttaagttaattgaactttttctttatttatttttcaaaaaaatgtttatatcacatagacatattacatcggctaaagcaagacttggcccacaaatacctatttgttgctgaatgaatacaatggataaagcaaggctgttgtagctgaagttacatagggaatcccaaactctgccctcttagcatcttattctacatgacaactctcaaggtactcacagatctgtttaacccacttgaaaaaaaaacactaaaaatgaagaaatgctataagtataaactatgattttatttataaattctgtattaaaatggaattatatgcaacattctttcattctgtaaactaattccatttgcattcctcataagcattgtagtaaattgatcatattacatgtactaaggaatgagattatatgcagtaaacccaactggaagattaacaatattaaaatatgaaacatttttaagacaaaggcattacttctcagtattaccaaacctaaactggttgaaggtgaaagtgtgctatggccttttcaagcctaagaagtctctcttactgagtaaaccagaggcttgcatcgctattctttcacctgtcaatattaataagaaaatagtctcatctcacttaaatgaggcaaatgtaatagttaaaattcaacatacttataaaaaactagtgtcatgtacctgccatgaacatgacaaaaggttagtcttcaatagactgaaatgtataagagaagaaccaagtcttacatagaaaaaaaaggtagatatgaaaagaaaaatcacagaagagagaatgcaaatggccactaagtatatgaaaaaagtcgtatcttaacagtgaacaactgtgttagtctgtatcaatcagaagacagaaacaaggtagtaatttaaacagggaaagtttaatataaataataattaagctatgataggagaataataataaagatgaaaagagaaggtaccctaaggctgagggaaagaatcctaacaaggaaaggcaggaatgagggtttcagaattcactggagaaggtgtggttgcagcccactggagagaagtttgctggcttgcccaggccagagcaggaccacagatactggacaagctggtacagccaaccccctaggtgtggaccagctgaggcaggtgggcagatatgcagagggacttggggctttgccaaagggtaagcacaaagaaggagtcacgggttctgttcgaggcactgttgggattaggagtcggagggacctactttgcaggaacctagcataactttgtgtgacgagactgcacaagacaaagctcaggcaagtggctcagtagttggccagcccagcagggtcctctgtatgagtgtgcacccagctgaagagaagaaatggagagcagcaattggagcttcaggaccggcttgcactgtggctccaggttataccaccactgcccaaagcaaaagctagagaagcaagtggagaaatgctggagaaagctgcaccctacaggcaaccagcactgcagaaaccactccaggcaaagtagtgaaggaaaaaagcctgctctccagtagcctggcctgtcagcctggaggaatcaggaaagaccccttcctcttgcagtgtgtctccagcgccctctactgacaaagtatgccatcatgcaagctgcaaaggaaacatttcaagagtctatatctattttcacggagcgggcaaccaacagtgaatgtggagctgagagacagtaaaataataactgacatgccaccgaagtacaaagtaaaataaataaataaatacacattttggcctattagcaaagattaagaaatgataacattaaatactcaataaatcaccatgagatggggactcaaacttctggtaaaaatacaaatagatataatttttcttgaaggcaatttagtagtctgtttatcctataattctacttgtaagatcctatcatatgaaaataaccagagatacaaagacattctgcaaagatatgttttatattgttatttattgtgacaaaaggaaataaaaagcctaaatgttcagaaaattattttaaaagatgaaagagggaaataggccatggacggtggctcacgcctgtaatcccagcactttaggaggccaaggtaggtggatcacttgaggttgggatttcgagaccagcctggccaacatggtgaaaccctgcctctactaaaaatacaaaaaatgagccgggtgcaatggcaggcgcctataatgccagctactcgggaggctgaggcaggagaatcgcttgaacccgggaggcggaggttgcatgagccgagatggcgccactgctctccagcctggacgacagagcaagactccgtctct

SEQ ID NO: 5669 - DNA, 2142 bp, Homo sapiens
cggccccccgcattccccgcccccacctccccgccttgttgtccaacttctcccggagcagccggagagcaggcgtcgggacgcagcaaagagaggagagaccccagagtcagaaggagtgagaaccctgacccctaatcccactgcatccagccaataggagcccagccaccatggcggagctgcaggaggtgcagatcacagaggagaagccactgttgccaggacagacgcctgaggcggccaaggaggctgagttagctgcccgaatcctcctggaccagggacagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaatatcattacacatgcacccaacctggataacattgaattgtactggaacagctacaacaaccgccgagacctgaactttgagcgtggaggtgatatcaccctcaggtgtcctgtgatgctggtggtaggagaccaagcacctcatgaagatgcagtggtggaatgtaactcaaaactggaccccacccagacctcgttcctcaagatggctgactccggaggtcagccccagctgactcagccaggcaagctgaccgaggccttcaagtacttcctgcaaggcatgggctacatggcctcatcctgcatgactcgcctgtcccggtctcgtacagcctctctgaccagtgcagcatccgttgatggcaaccggtcccgctctcgcaccctgtcccagagcagcgagtctggaactctttcttcggggcccccggggcacaccatggaggtctcctgttgaatggcccttgttgccctagagtgggacccagccctcacctcccccagagctaacctgggaggtgctgaaggggcattgggccaccgtaagcaagggaaaaagggcagatcatgcggggagatgaccttgatctttgattgctaccctaaccttgacctttaacccgtgattccccccagctcctggaagagatgtcctaatatctcttagggacccagacccctaaattctcctcctcccccattttgatgttaaggtggagagggcatatgcatcctctgtcctgatctaggtgtctatagctgaggggtaagaggttgttgtagttgtcctggtgcctccatcagactctccctacttgtcccatatttgcaaggggaggggatttggggctggggctccattcaccaaagctgaggtggcttctcattaaccctttaggactctgaagggtatggacctacgtgaatgtgtgtcagggggagacttgctggtgggttagtggtcctcaggatgtgatagaaacatccagtgtaaaaaggaagttggaatgggagttggcgggcagtgaacgagtgtggggaaggattggtgctggggcaacaggaaggggcctggggccgtttggctgcactaactttggtagctcagtgtgcatctagagtgggactggggagggagctaagcttgggctgggctgcttggggcttggcatagggtggaaagggctaccctggggctctgaccacactgtagtatgtgtggagggtgccctcccgtctcccacaacttctgctataacaataaactgtagaggaatctgagtaccgttaaaaaaaaaaaaaaaaaaaaa

SEQ ID NO: 5670 - DNA, 7794 bp, Homo sapiens
gggccggggggcggagccttgcgggctggagcgaaagaatgcgggggctgagcgcagaagcggctcgaggctggaagaggatcttgggcgccgccagtctctctctgttgcccaagctggagtgcagtggcacagtcttggctcactgcaacctccacctcctgggtgcaagcgattctcgtgtctcagcctctcaagtagctgggattacagtctttagcaccagttggtgtaggagttgagacctacttcacagtagttctgtggacaatcacaatgggaatccaaggagggtctgtcctgttcgggctgctgctcgtcctggctgtcttctgccattcaggtcatagcctgcagtgctacaactgtcctaacccaactgctgactgcaaaacagccgtcaattgttcatctgattttgatgcgtgtctcattaccaaagctgggttacaagtgtataacaagtgttggaagtttgagcattgcaatttcaacgacgtcacaacccgcttgagggaaaatgagctaacgtactactgctgcaagaaggacctgtgtaactttaacgaacagcttgaaaatggtgggacatccttatcagagaaaacagttcttctgctggtgactccatttctggcagcagcctggagccttcatccctaagtcaacaccaggagagcttctcccaaactccccgttcctgcgtagtccgctttctcttgctgccacattctaaaggcttgatattttccaaatggatcctgttgggaaagaataaaattagcttgagcaacctggctaagatagaggggctctgggagactttgaagaccagtcctgtttgcagggaagccccacttgaaggaagaagtctaagagtgaagtaggtgtgacttgaactagattgcatgcttcctcctttgctcttgggaagaccagctttgcagtgacagcttgagtgggttctctgcagccctcagattatttttcctctggctccttggatgtagtcagttagcatcattagtacatctttggagggtggggcaggagtatatgagcatcctctctcacatggaacgctttcataaacttcagggatcccgtgttgccatggaggcatgccaaatgttccatatgtgggtgtcagtcagggacaacaagatccttaatgcagagctagaggacttctggcagggaagtggggaagtgttccagatagcagggcatgaaaacttagagaggtacaagtggctgaaaatcgagtttttcctctgtctttaaattttatatgggctttgttatcttccactggaaaagtgtaatagcatacatcaatggtgtgttaaagctatttccttgccttttttttattggaatggtaggatatcttggctttgccacacacagttacagagtgaacactctactacatgtgactggcagtattaagtgtgcttattttaaatgttactggtagaaaggcagttcaggtatgtgtgtatatagtatgaatgcagtggggacaccctttgtggttacagtttgagacttccaaaggtcatccttaataacaacagatctgcaggggtatgttttaccatctgcatccagcctcctgctaactcctagctgactcagcatagattgtataaaatacctttgtaacggctcttagcacactcacagatgtttgaggctttcagaagctcttctaaaaaatgatacacacctttcacaagggcaaactttttccttttccctgtgtattctagtgaatgaatctcaagattcagtagacctaatgacatttgtattttatgatcttggctgtatttaatggcataggctgacttttgcagatggaggaatttcttgattaatgttgaaaaaaaacccttgattatactctgttggacaaaccgagtgcaatgaatgatgcttttctgaaaatgaaatataacaagtgggtgaatgtggttatggccgaaaaggatatgcagtatgcttaatggtagcaactgaaagaagacatcctgagcagtgccagctttcttctgttgatgccgttccctgaacataggaaaatagaaacttgcttatcaaaacttagcattaccttggtgctctgtgttctctgttagctcagtgtctttccttacatcaataggtttttttttttttttttggcctgaggaagtactgaccatgcccacagccaccggctgagcaaagaagctcatttcatgtgagttctaaggaatgagaaacaattttgatgaatttaagcagaaaatgaatttctgggaacttttttgggggcggggggttggggaattcagccacactccagaaagccaggagtcgacagttttggaagcctctctcaggattgagattctaggatgagattggcttactgctatcttgtgtcatgtacccactttttggccagactacactgggaagaaggtagtcctctaaagcaaaatctgagtgccactaaatggggagatggggctgttaagctgtccaaatcaacaagggtcatataaatggccttaaactttggggttgctttctgcaaaaagttgctgtgactcatgccatagacaaggttgagtgcctggacccaaaggcaatactgtaatgtaaagacatttatagtactaggcaaacagcaccccaggtactccaggccctcctggctggagagggctgtggcaatagaaaattagtgccaactgcagtgagtcagcctaggttaaatagagagtgtaagagtgctggacaggaacctccaccctcatgtcacatttcttcaatgtgacccttctggcccctctcctcctgacagcggaacaatgactgccccgataggtgaggctggaggaagaatcagtcctgtccttggcaagctcttcactatgacagtaaaggctctctgcctgctgccaaggcctgtgactttctaacctggcctcacgctgggtaagcttaaggtagaggtgcaggattagcaagcccacctggctaccaggccgacagctacatcctccaactgaccctgatcaacgaagagggattcatgtgtctgtctcagttggttccaaatgaaaccagggagcaggggagttaggaatcgaacaccagtcatgcctactggctctctgctcgagagccaataccctgtgccctccactcatctggatttacaggaactgtcatagtgttcagtattgggtggtgataagcccattggattgtccccttggggggatgagctaggggtgcaaggaacacctgatgagtagataagtggagctcatggtatttcctgaaagatgctaatctatttgccaaacttggtcttgaatgtactgggggcttcaaggtatgggtatatttttcttgtgtccttgcagttagcccccatgtcttatgtgtgtcctgaaaaaataagagcctgcccaagactttgggcctcttgacagaattaaccacttttatacatctgagttctcttggtaagttctttagcagtgttcaaagtctactagctcgcattagtttctgttgctgccaacagatctgaactaatgctaacagatccccctgagggattcttgatgggctgagcagctggctggagctagtactgactgacattcattgtgatgagggcagctttctggtacaggattctaagctctatgttttatatacattttcatctgtacttgcacctcactttacacaagaggaaactatgcaaagttagctggatcgctcaaggtcacttaggtaagttggcaagtccatgcttcccactcagctcctcaggtcagcaagtctacttctctgcctattttgtatactctctttaatatgtgcctagctttggaaagtctagaatgggtccctggtgcctttttactttgaagaaatcagtttctgcctctttttggaaaagaaaacaaagtgcaattgttttttactggaaagttacccaatagcatgaggtgaacaggacgtagttaggccttcctgtaaacagaaaatcatatcaaaacactatcttcccatctgtttctcaatgcctgctacttcttgtagatatttcatttcaggagagcagcagttaaacccgtggattttgtagttaggaacctgggttcaaaccctcttccactaattggctatgtctctggacaagtttttttttttttttttttttaaaccctttctgaactttcactttctatgtctacctcaaagaattgttgtgaggcttgagataatgcatttgtaaagggtctgccagataggaagatgctagttatggatttacaaggttgttaaggctgtaagagtctaaaacctacagtgaatcacaatgcatttacccccactgacttggacataagtgaaaactagccagaagtctctttttcaaattacttacaggttattcaatataaaatttttgtaatggataatcttatttatctaaactaaagcttcctgtttatacacactcctgttattctgggataagataaatgaccacagtaccttaatttctaggtgggtgcctgtgatggttcattgtaggtaaggacattttctctttttcagcagctgtgtaggtccagagcctctgggagaggaggggggtagcatgcacccagcaggggactgaactgggaaactcaaggttctttttactgtggggtagtgagctgcctttctgtgatcggtttccctagggatgttgctgttcccctccttgctattcgcagctacatacaacgtggccaaccccagtaggctgatcctatatatgatcagtgctggtgctgactctcaatagccccacccaagctggctataggtttacagatacattaattaggcaacctaaaatattgatgctggtgttggtgtgacataatgctatggccagaactgaaacttagagttataattcatgtattagggttctccagagggacagaattagtaggatatatgtatatatgaaagggaggttattagggagaactggctcccacagttagaaggcgaagtcgcacaataggccgtctgcaagctgggttagagagaagccagtagtggctcagcctgagttcaaaaacctcaaaactggggaagctgacagtgcagccagccttcagtctgtggccaaaggcccaagagcccctggcaaccaacccactggtgcaagtcctagattccaaaggctgaagaacctggagtctgatgtccaagagcaggaagagtggaagaaagccagaagactcagcaaacaaggtagacagtgtctaccaccatagtggccataccaaagaggctaccgattccttcctgctacctggatccctgaagttgccctggtctctgcaccttctaaacctagttcttaagagctttccattacatgagctgtctcaaagccctccaataaattctcagtgtaagcttctgttgcttgtggacagaaaattctgacagacctaccctataagtgttactgtcaggataacatgagaacgcacaacagtaagtggtcactaagtgttagctacggttattttgcccaaggtagcatggctagttgatgccggttgatggggcttaaacccagctccctcatcttccaggcctctgtactccctattccactaaactacctctcaggtttatttttttaaattcttactctgcaagtacataggaccacatttacctgggaaaacaagaataaaggctgctctgcattttttagaaacttttttgaaagggagatgggaatgcctgcacccccaagtccagaccaacacaatggttaattgagatgaataataaaggaaagactgttctgggcttcccagaatagcttggtccttaaattgtggcacaaacaacctcctgtcagagccagcctcctgccaggaagaggggtaggagactagaggccgtgtgtgcagccttgccctgaaggctagggtgacaatttggaggctgtccaaacaccctggcctctagagctggcctgtctatttgaaatgccggctctgatgctaatcggcgaccctcaggcaagttacttaaccttacatgcctcagttttctcatctggaaaatgagaaccctaggtttagggttgttagaaaagttaaatgagttaagacaagtgcctgggacacagtagcctcttgtgtgtgtttatcattatgtcctcagcaggtcgtagaagcagcttctcaggtgtgaggctggcgcattatctggagtgggttgggttttctaggatggaccccctgctgcattttcctcattcatccaccagggcttaatggggaatcaaggaatccatgtgtaactgtataataactgtagccacactccaatgaccacctactagttgtccctggcactgcttatacatatgtccatcaaatcaatcctatgaagtagatactgtcttcattttatagatcagagacaattggggttcagagagctgatgtgattttcccagggtcacagagagtcccagattcaggcacaactcttgtattccaagacacaaccactacatgtccaaaggctgcccagagccaccgggcacggcaaattgtgacatatccctaaagaggctgagcacctggtcaggatctgatggctgacagtgtgtccagatgcagagctggagtgggggaggggaaggggggctccttgggacagagaaggctttctgtgctttctctgaagggagcagtctgaggaccaagggaacccggcaaacagcacctcaggtactccaggccctcctggctggagagggctgtggcaatggaaaattagtgccaactgcaatgagtcagcctcggttaaatagagagtgaagaatgctggacaggaacctccaccctcatgtcacatttcttcagtgtgacccttctggcccctctcctcctgacagcggaacaatgactgccccgataggtgaggctggaggaagaatcagtcctgtccttggcaagctcttcactatgacagtaaaggctctctgcctgctgccaaggcctgtgactttctaacctggcctcacgctgggtaagcttaaggtagaggtgcaggattagcaagcccacctggctaccaggccgacagctacatctttcaactgaccctgatcaacgaagagggacttgtgtctctcagttggttccaaatgaaaccagggagcaggggcgttaggaagctccaacaggatggtacttaatggggcatttgagtggagaggtaggtgacatagtgctttggagcccagggagggaaaggttctgctgaagttgaattcaagactgttctttcatcacaaacttgagtttcctggacatttgtttgcagaaacaaccgtagggttttgccttaacctcgtgggtttattattacctcatagggactttgcctcctgacagcagtttatgggtgttcattgtggcacttgagttttcttgcatacttgttagagaaaccaagtttgtcatcaacttcttatttaaccccctggctataacttcatggattatgttataattaagccatccagagtaaaatctgtttagattatcttggagtaagggggaaaaaatctgtaattttttctcctcaactagatatatacataaaaaatgattgtattgcttcatttaaaaaatataacgcaaaatctcttttccttctaaaaaaaaaaaaaaaaaa

SEQ ID NO: 5671 - DNA, 1518 bp, Homo sapiens
aggggcactgctctgtccgagtgctgcccttggggcgaggcgggcatgtggctctacaaggtggagtccaggcggccaaagtttggaaaggactttccttatcccagttgattgtgcagaatacactgcctgtcgcttgtcttctattcaccatggcttcttctgatatccaggtgaaagaactggagaagcgtgcctcaggccaggcttttgagctgattctcagccctcggtcaaaagaatctgttccagaattccccctttcccctccaaagaagaaggatctttccctggaggaaattcagaagaaattagaagctgcagaagaaagacgcaagtcccatgaagctgaggtcttgaagcagctggctgagaaacgagagcacgagaaagaagtgcttcagaaggcaatagaagagaacaacaacttcagtaaaatggcagaagagaaactgacccacaaaatggaagctaataaagagaaccgagaggcacaaatggctgccaaactggaacgtttgcgagagaaggataagcacattgaagaagtgcggaagaacaaagaatccaaagaccctgctgacgagactgaagctgactaatttgttctgagaactgactttctccccatccccttcctaaatatccaaagactgtactggccagtgtcattttattttttccctcctgacaaatattttagaagctaatgtaggactgtataggtagatccagatccagactgtaagatgttgttttaggggctaaaggggagaaactgaaagtgttttactctttttctaaagtgttggtctttctaatgtagctatttttcttgttgcatcttttctacttcagtacacttggtgtactgggttaatggctagtactgtattggctctgtgaaaacatatttgtgaaaagagtatgtagtggcttcttttgaactgttagatgctgaatatctgttcacttttcaatcccaattctgtcccaatcttaccagatgctactggacttgaatggttaataaaactgcacagtgctgttggtggcagtgacttcttttgagttaggttaataaatcaagccatagagcccctcctggttgatacttgttccagatggggcctttggggctggtagaaatacccaacgcacaaatgaccgcacgttctctgccccgtttcttgccccagtgtggtttgcattgtctccttccacaatgactgctttgtttggatgcctcagcccaggtcagctgttactttctttcagatgtttatttgcaaacaaccattttttgttctgtgtcccttttaaaaggcagattaaaagcacaagcgtgtttctagagaacagttgagagagaatctcaagattctacttggtggtttgcttgctctacgttacaggtggggcatgtcctcatcctttcctgccataaaagctatgacacgagaatcagaatattaataaaactttatgtactgctgtagcaaaaaaaaaaaaaaaaaa

SEQ ID NO: 5672 - DNA, 7257 bp, Homo sapiens
cattttgtctcctgtaacaatttacgcgccgtgtaactgtgaatctttcaaagcctcagttttatgaccctgtggagccagtggactttgaaggacttctgatgacacacctgaacagcctggatgtgcagcttgcccaggagctcggggacttcactgatgacgacttggacgtggtgttcacgccaaaggaatgtaggactttgcagccctctttgccggaggaaggggttgaactggaccctcatgtcagggactgtgttcagacctacatccgtgagtggctaatcgtgaaccggaaaaaccaaggaagtccagaaatctgtggctttaaaaagactggatctcgaaaagattttcacaagacgcttccgaaacagacgtttgagtcggaaaccttggagtgcagtgaacccgctgctcaggcaggcccccgccacttaaacgtgctgtgcgacgtgtctgggaaaggccccgtcactgcctgtgactttgacctccgcagcctgcagcctgacaagcggctagaaaacctcctgcagcaagtgagtgccgaggactttgagaagcagaacgaggaggcccggaggaccaataggcaggccgagctctttgccctttacccatcagtggacgaggaggatgctgtggaaatacgtccagtaccagaatgtcccaaggaacacctgggcaacagaatattggtcaagttgctgaccttgaagttcgagattgaaattgagcccctgtttgccagcattgccctctacgatgttaaagaaaggaaaaagatctcagaaaattttcactgtgacctgaactctgaccagttcaaaggatttctgcgagctcacacgccttcagtggccgcatcaagtcaggcgagatctgcagtcttctcagtcacctacccgtcctcagacatctacctggtagtcaagattgaaaaagtcctgcagcagggagagattggagactgtgcagagccctacacggttatcaaagaaagtgatggtggaaagagtaaagaaaagattgaaaaactaaaactccaagctgaatccttctgccagcgtttggggaaataccggatgccctttgcctgggcacccataagcttatcaagcttcttcaatgtctccacccttgagagggaggtaactgatgtggactctgtggttgggagaagctcagtgggtgaacggaggacattggcccaatctagaaggctttctgaaagagccctctccttggaggaaaatggggttggatccaacttcaaaacctccactctgagcgttagcagctttttcaagcaggaaggagatcgccttagcgatgaagacttattcaagtttttagctgactacaaaagatcatcatccttacagagacgagtcaagtcaattccaggcttgctaagactggagatttctacagctccagagatcatcaattgctgtctgactcctgaaatgctgcccgtgaaaccctttcctgaaaaccggacacgcccgcacaaagagattttggaatttccaacacgagaagtatatgtccctcacactgtgtacagaaaccttctctatgtctacccacagaggctgaactttgtaaacaaactagcatcagcccggaacattacaataaagatccagtttatgtgtggagaagatgctagcaatgcgatgccggtcatctttggaaaatccagcgggcctgaatttctgcaggaagtgtacacagctgttacataccataataagtctcctgacttttatgaagaagtgaaaattaagctccccgctaagctcacagtaaatcaccacctcctgttcaccttctaccatatcagctgtcagcagaagcaaggagcctccgtggaaactctcctgggatattcatggctgccaattctcttaaatgaacgtcttcaaactggatcctactgtctcccagttgccttggaaaaattgccacccaactactccatgcattctgctgagaaagtcccattacagaatcctcccattaagtgggctgaaggacataagggagtatttaatattgaagtgcaagctgtttcttctgtacacacccaggacaaccacctggagaagttcttcaccctctgccactccctggagagccaggtgaccttccccatccgcgtgctggatcagaaaatcagcgagatggcgctggagcatgagctgaagctcagcatcatctgcctgaactcctcccgcctggagccgctcgtgctcttcctgcacctggtgctggacaagctcttccagctgtccgtgcagcccatggtcatcgctggccagacagccaacttctcccagtttgccttcgagtccgtggtggccatcgccaacagtctgcacaacagcaaggacctgagcaaggaccagcatgggaggaactgcctgctggcttcctacgtgcactacgtcttccgcctgccagaggtgcaaagggatgtgcccaagtcaggcgctcccactgccctcctagaccctcggagctaccacacgtatggccgcacatcagctgctgctgtgagttcaaagctgctgcaggcccgggtgatgagcagcagtaacccagacctcgcggggacacactccgcagcagacgaggaagtgaagaacatcatgtcttcaaagatcgccgatcgcaactgcagccgaatgtcttactattgctctggcagtagtgatgctccaagttcacctgcagccccaaggccagccagcaaaaagcatttccatgaggagcttgcccttcagatggtggtcagcaccggaatggtgagagaaacagtcttcaagtatgcctggttcttctttgagcttctggtgaaaagcatggcccagcacgtacataacatggacaaacgggacagttttcggaggactcgtttttctgaccgtttcatggatgacataactactattgttaatgtggtcacctcggaaattgcagcccttttagtaaaaccacagaaggaaaatgaacaggcggaaaagatgaacatcagcctggctttcttcttgtatgaccttctctccctcatggatcggggctttgtgtttaacctcatcagacattattgcagccagctgtcagccaagctcagtaaccttccaacgctcatttccatgaggctagagttcctgagaatcctctgtagccatgagcattacctcaatctgaaccttttttttatgaatgctgatactgctccaacatctccttgtccttccatatcttcccagaactcaagctcctgctccagcttccaggaccagaagatcgccagcatgttcgatctgacttccgagtaccgccagcagcacttcctcaccgggctcctcttcacagaactggctgctgccctggatgccgaaggggaaggaatcagcaaagtacaaaggaaagctgtcagtgcaattcacagcctgctaagttctcacgacctggacccacgctgtgtcaaaccagaggtgaaggtcaaaatcgccgccctttacctacctttagttggcatcattttggatgctttgccacagctctgtgactttacagttgcagatactcgcagataccgcaccagtggctcggatgaagaacaagaaggagccggtgccattaaccagaatgtggctctggccatagcagggaataatttcaatttgaaaacaagtggaatagtgctgtcttccttgccctataagcagtacaacatgctgaacgcggacactactcgcaacctcatgatctgcttcctctggatcatgaaaaatgctgatcagagcctcattaggaagtggattgctgacctgccatcaacgcagctcaacaggattttagatctacttttcatctgtgtgttatgttttgagtataagggaaaacagagttctgacaaagtcagtacccaagtcctgcagaagtcaagggatgtcaaggcccggctggaagaggctttgctccgtggggaaggggccagaggggagatgatgcgccgccgggctccagggaacgaccgatttccaggcctaaatgaaaatttgagatggaagaaagagcagacacattggcggcaagctaatgagaagctagataaaacaaaggccgagttagatcaagaagccttgatcagtggcaatctggctacagaagcacatttaatcatcctggatatgcaggaaaacattatccaggcgagctcggctctggactgtaaagacagcctgctgggaggtgttctgagggtgctggtgaattctctgaactgtgatcagagtaccacctacctgactcactgctttgcaacactccgtgctctcatcgccaagtttggagacttactcttcgaagaggaggtggaacagtgtttcgacctatgtcaccaagtcctgcaccactgcagcagcagcatggatgtcacccggagccaagcctgtgccaccctttacctcctcatgaggttcagttttggagccaccagtaattttgcaagagtaaagatgcaagtaaccatgtccctggcatctttggtgggaagagcaccagactttaatgaagagcacctgagaagatccttgaggacaattttggcctattcagaagaggacacagccatgcagatgactccttttcccacccaggtggaggaacttctctgtaatctgaatagcatcttatatgacacagtgaaaatgagggaatttcaggaagatcctgagatgcttatggatctcatgtacagaattgccaagagttaccaggcatctcctgatctgcggctgacctggctccagaacatggcagagaaacacaccaagaagaagtgctacacggaggctgccatgtgcctggtgcacgccgctgcgttagtggctgagtatctgagcatgctggaggaccacagctacctgcccgtgggcagtgtcagcttccagaatatttcttccaatgtgctggaggagtctgtggtctctgaggacaccctgtcacctgacgaggatggggtgtgcgcaggccagtacttcaccgagagtggcctggtaggcctcctggagcaggccgcggagctcttcagcacgggaggcttatatgagacagttaatgaggtctacaagctggtcatccccatcctagaagcgcatcgagaattccggaagctgacactcactcacagcaagctgcagagagccttcgacagcatcgttaacaaggatcataagagaatgtttggaacctacttccgagttggtttctttggatccaaatttggggatttggatgaacaggagtttgtctacaaagagcctgcaattaccaagcttcctgagatctcacatagactagaggcattttatggtcaatgttttggtgcagaatttgtggaagtgattaaagactccactcctgtggacaaaaccaagttggatcctaacaaggcctacatacagatcacttttgtggagccctactttgatgagtatgagatgaaagacagggtcacatactttgagaagaatttcaacctccggaggttcatgtacaccaccccgttcaccctggaggggcggcctcggggagagctgcatgagcagtacagaaggaacacagtcctgaccactatgcacgccttcccctacatcaagaccaggatcagcgtcatccagaaggaggagtttgttttgacaccgattgaagttgccattgaagacatgaagaagaagaccctgcagttagcagttgccattaaccaggagccgcctgatgcaaagatgcttcagatggtgctgcaaggctctgtgggagctactgtaaatcagggaccactggaagtagcccaagtgtttttggctgaaattcctgctgatccaaaactctatcgacatcacaacaagttgaggttatgctttaaggaattcatcatgagatgtggtgaagctgtagagaaaaacaagcgtctcatcacggcagaccagagggaatatcagcaggaactcaaaaagaactataacaagctaaaagagaacctcaggccaatgatcgagcggaaaattccagaactgtacaagccaatattcagagttgagagtcaaaagagggactccttccacagatctagtttcaggaaatgtgaaacccagttgtcacagggcagctaagaaaagccatcttcattcgtggagactgtggccctgcaaccctggagaaggacttgctggtacttaaaaaatgggacatttgccacccaggactgactgtacactccctgatcagccagcactctggaagctttgggatcccaggaaccatggaattattcccaaatggactctgaccagatttttgccatactggggggtggcgggatggaggatgggtactcaggcatgactgcgtatttattaaagtgtgtttttccacaatgtaccaaacaaggcataagcagcttctcctgctgactggccaatcactgcccatctgagagatgatttcctctggcccatatttgaatttattggagtaactcaaattgcctgaggaaaaatggaaaaattatccaccagtcgattcaaactgaatttcactctttataggaaggcagggcaaacttgtaggagtacgaaacattttcaataaatctacaaagggaagccttactacaattccaaaaatcatcatggttggaaatttgggaggagattatttgtgaacttgttacccttttggtaatggtggactaattgctgtatagttatttttgttttattattactgttacattaatttaacatgcatttatagaagaatacattcaaagcactgatgtaggagatacacggtacttggagcagtcagccagaaatcacagatactgctttcacttaaatggaaacaattctccgataatgctttgctttttttcttatgtcactcttgtgtactatctatttttctcctctctgggaccaagtttctttttataaagcaataatatctctgttttcatttcagaacattgtgctgtctgtcagcatatgtatatcagctacaaaatatattcaactttgacttcttttgacaaaggactttaggaaaaagaggaacaaagacattatttgagaattaaattatatatttttaatatgactgtgaccttgactgataataaagatgtaataagaattgcaagctaaaaaaaaaaaaaaaaaaaaaaaaaaa

SEQ ID NO: 5673 - DNA, 2694 bp, Homo sapiens
ctcgggccgctgcgctcctggccagctccccccagcgcctgggaggcgacccccagtgcgcccgggttcaaaggcccggcgaggcagttccagcccctctggggggcggggaggcgacgggggtggtgcagaagccagaaaagcccgagccacagccggccagctccgcgcagggatgggcagcgcgctctgaaagtttatgaccgccgcagccaactcctggccggagctggagacgcagcgagcgatcggccggcctcgaacccccacagctggagggcgaggccagctgtacccggccccagtgccctttcgcggccacaagcggccgtcctcctggtccggtgctccggcgcctgatctaggttcatggagccggggctgtggctccttttcgggctcacagtgacctccgccgcaggattcgtgccttgctcccagtctggggatgctggcaggcgcggcgtgtcccaggcccccactgcagccagatctgagggggactgtgaagagactgtggctggccctggcgaggagactgtggctggccctggcgaggggactgtggccccgacagcactgcagggtccaagccctggaagccctgggcaggagcaggcggccgagggggcccctgagcaccaccgatccaggcgctgcacgtgcttcacctacaaggacaaggagtgtgtctactattgccacctggacatcatttggatcaacactcccgaacagacggtgccctatggactgtccaactacagaggaagcttccggggcaagaggtctgcggggccacttccagggaatctgcagctctcacatcggccacacttgcgctgcgcttgtgtggggagatatgacaaggcctgcctgcacttttgcacccaaactctggacgtcagcagtaattcaaggacggcagaaaaaacagacaaagaagaggaagggaaggtgagaggtgccaacagaggcctgtgtcaaaggaggttgaagtcaaggaccaacaaagcaagcaggctttagacctccaccatccaaagctcatgcccggcagtggactcgccctcgctccatctacctgcccccgctgcctctttcaggaaggagccccttaggaggacaggcctgcagcatcctggtctcgggaggcttctgtcattgctcacacacagttcagatttccacctctttatagacaagaagtgaatttgcctggggcagaacacccacccaaagagtccccacttaacaataccccccccccacggcaagaatgcccaaatccgaatgaccccagttttcctaatgagtaaaatgatcccagatgtgccccagagcatgacgcctgcagctccggtttcatgcaggaaattggttttggagagttttggcaagttggaaagccacttactggcttttgacatgacttctcttggagaataagtggactccaagctaactctttgcaaatgtaaacacatgtccatcttgtaataaatgcaaaatgcccgtgcagcagaagcatgcgactttcatatccttgcctagaataggctgcatggtgtatgtcagtgagggccacgaggcgtcggctttagacacagatcatagctctacaggagtttatgaatttgaagcttatgggattttggcagagaaattttcagctgtgcttgatacccaccaaaagaatgtatctcgaaagaatgaaggaagaagaaaaaaggatccttgatgtttgtgacaagaaaatgagaaagttagtatctgcaatacagagcttgttcctgttcagtgactgaccctctgtattctgtatagacaccaggccgatacacagtggagttcccaggccttgtttgcaggaagccgactgtaaagacagccccagctcaaggctattaggttgaatatttgctttcatgagtaaatgtggatctttggggaatggcttcaaaataagtcacgaacacaaattctttgtaaattatgtaaattcctgtttatataaattggcaacaacttataccgtctgacagttcaaaatctctttcagctgcgctcttcccaccgagccgagcttactgtgagtgtggagatgttatcccaccatgtaaagtcgcctgcgcaggggagggctgcccatctccccaacccagtcacagagagataggaaacggcatttgagtgggtgtccagggccccgtagagagacatttaagatggtgtatgacagagcattggccttgaccaaatgttaaatcctctgtgtgtatttcataagttattacaggtataaaagtgatgacctatcatgaggaaatgaaagtggctgatttgctggtaggattttgtacagtttagagaagcgattatttattgtgaaactgttctccactccaactcctttatgtggatctgttcaaagtagtcactgtatatacgtatagagaggtagataggtaggtagattttaaattgcattctgaatacaaactcatactccttagagcttgaattacatttttaaaatgcatatgtgctgtttggcaccgtggcaagatggtatcagagagaaacccatcaattgctcaaatactcagaaagtactgtcaaaagcctaataaaaaacctaaagtttgctctgaaaaaaaaaaaaaaaaaaaaaaaaaaaaaaaaaaaaaaaaa

SEQ ID NO: 5674 - DNA, 3881 bp, Homo sapiens
attccagtgtttcagcgaggtggaagtgtgataccaataaagacaactgtaggaaaatccacaggctggatgactgaatcctcctatggactccgggttgctctaagcactaagggttcttcagtgggtgagttatatcttgatgatggccattcattccaatacctccaccagaagcaatttttgcacaggaagttttcattctgttccagtgttctgatcaatagttttgctgaccagaggggtcattatcccagcaagtgtgtggtggagaagatcttggtcttaggcttcaggaaggagccatcttctgtgactacccactcatctgatggtaaagatcagcctgtggcttttacgtattgtgccaaaacatccatcctgagcctggagaagctctcactcaacattgccactgactgggagggttcctaaaaaagctctaaaatgaatgcatagtgtgtctttccttcaagatgtaaatgtcaaggaatgagttggcaaatcagtttaaaaacacaaactacccaacagaaaaatgaaatttgcgagaatccccgatttatcattgatggagccaacagaactgacatctgtcaaggagagctaggggactgctggtttctcgcagccattgcctgcctgaccctgaaccagcaccttcttttccgagtcataccccatgatcaaagtttcatcgaaaactacgcagggatcttccacttccagttctggcgctatggagagtgggtggacgtggttatagatgactgcctgccaacgtacaacaatcaactggttttcaccaagtccaaccaccgcaatgagttctggagtgctctgctggagaaggcttatgctaagctccatggttcctacgaagctctgaaaggtgggaacaccacagaggccatggaggacttcacaggaggggtggcagagttttttgagatcagggatgctcctagtgacatgtacaagatcatgaagaaagccatcgagagaggctccctcatgggctgctccattgatgatggcacgaacatgacctatggaacctctccttctggtctgaacatgggggagttgattgcacggatggtaaggaatatggataactcactgctccaggactcagacctcgaccccagaggctcagatgaaagaccgacccggacaatcattccggttcagtatgagacaagaatggcctgcgggctggtcagaggtcacgcctactctgtcacggggctggatgaggtcccgttcaaaggtgagaaagtgaagctggtgcggctgcggaatccgtggggccaggtggagtggaacggttcttggagtgatagatggaaggactggagctttgtggacaaagatgagaaggcccgtctgcagcaccaggtcactgaggatggagagttctggatgtcctatgaggatttcatctaccatttcacaaagttggagatctgcaacctcacggccgatgctctgcagtctgacaagcttcagacctggacagtgtctgtgaacgagggccgctgggtacggggttgctctgccggaggctgccgcaacttcccagatactttctggaccaaccctcagtaccgtctgaagctcctggaggaggacgatgaccctgatgactcggaggtgatttgcagcttcctggtggccctgatgcagaagaaccggcggaaggaccggaagctaggggccagtctcttcaccattggcttcgccatctacgaggttcccaaagaggtatagcagcagcagcggccagcagttgtgtgcagcactacccagggggccccgagtctgtctgtggctcgtcgagaagcttcctggtggggtttgtgggcaggactgtgataggagagggccttgcctgtgttatttccactgcagagcaggtgcctcagggcattgcatgacccatgactaccacccccaggatgtgcactttctccctcgcaccagacactgcacgtcacacacatgcctttgcacactcaccctcctccacgcttacagccacacacacagtcacacagacgcgttctgagggtggctgcccgcttgggatggaggaatcacttccctcagaacccagccaagtcctctaggcctccttgggggtccttccagcctgaggggcttcggagctgaggagcagctgttctggtaagtgtccctgagtgtggggatgacacatttgccattcactctgaatcacaacagaaaaggaagaggaagtgaggtagggaggctatttaagccttgggagtcggaagtagggaggttgaaactgtgacatgggtgaccagggagttgggaagggacccttggaggtggctgtggcaggacaggatgttcctcccgaggggctcatgtgccctgggctctccccatctctcagatgcacgggaacaagcagcacctgcagaaggacttcttcctgtacaacgcctccaaggccaggagcaaaacctacatcaacatgcgggaggtgtcccagcgcttccgcctgcctcccagcgagtacgtcatcgtgccctccacctacgagccccaccaggagggggaattcatcctccgggtcttctctgaaaagaggaacctctctgaggaagttgaaaataccatctccgtggatcggccagtgcccatcatcttcgtttcggacagagcaaacagcaacaaggagctgggtgtggaccaggagtcagaggagggcaaaggcaaaacaagccctgataagcaaaagcagtccccacagccacagcctggcagctctgatcaggaaagtgaggaacagcaacaattccggaacattttcaagcagatagcaggagatgacatggagatctgtgcagatgagctcaagaaggtccttaacacagtcgtgaacaaacacaaggacctgaagacacacgggttcacactggagtcctgccgtagcatgattgcgctcatggatacagatggctctggaaagctcaacctgcaggagttccaccacctctggaacaagattaaggcctggcagaaaattttcaaacactatgacacagaccagtccggcaccatcaacagctacgagatgcgaaatgcagtcaacgacgcaggattccacctcaacaaccagctctatgacatcattaccatgcggtacgcagacaaacacatgaacatcgactttgacagtttcatctgctgcttcgttaggctggagggcatgttcagagcttttcatgcatttgacaaggatggagatggtatcatcaagctcaacgttctggagtggctgcagctcaccatgtatgcctgaaccaggctggcctcatccaaagccatgcaggatcactcaggatttcagtttcaccctctatttccaaagccatttacctcaaaggacccagcagctacacccctacaggcttccaggcacctcatcagtcatgctcctcctccattttaccccctacccatccttgatcggtcatgcctagcctgaccctttagtaaagcaatgaggtaggaagaacaaacccttgtccctttgccatgtggaggaaagtgcctgcctctggtccgagccgcctcggttctgaagcgagtgctcctgcttaccttgctctaggctgtctgcagaagcacctgccggtggcactcagcacctccttgtgctagagccctccatcaccttcacgctgtcccaccatgggccaggaaccaaaccagcactgggttctactgctgtggggtaaactaactcagtggaatagggctggttactttgggctgtccaactcataagtttggctgcattttgaaaaaagctgatctaaataaaggcatgtgtatggctggtc

SEQ ID NO: 5675 - DNA, 8815 bp, Homo sapiens
gcccgcgccggctgtgctgcacagggggaggagagggaaccccaggcgcgagcgggaagaggggacctgcagccacaacttctctggtcctctgcatcccttctgtccctccacccgtccccttccccaccctctggcccccaccttcttggaggcgacaacccccgggaggcattagaagggatttttcccgcaggttgcgaagggaagcaaacttggtggcaacttgcctcccggtgcgggcgtctctcccccaccgtctcaacatgcttaggggtccggggcccgggctgctgctgctggccgtccagtgcctggggacagcggtgccctccacgggagcctcgaagagcaagaggcaggctcagcaaatggttcagccccagtccccggtggctgtcagtcaaagcaagcccggttgttatgacaatggaaaacactatcagataaatcaacagtgggagcggacctacctaggcaatgcgttggtttgtacttgttatggaggaagccgaggttttaactgcgagagtaaacctgaagctgaagagacttgctttgacaagtacactgggaacacttaccgagtgggtgacacttatgagcgtcctaaagactccatgatctgggactgtacctgcatcggggctgggcgagggagaataagctgtaccatcgcaaaccgctgccatgaagggggtcagtcctacaagattggtgacacctggaggagaccacatgagactggtggttacatgttagagtgtgtgtgtcttggtaatggaaaaggagaatggacctgcaagcccatagctgagaagtgttttgatcatgctgctgggacttcctatgtggtcggagaaacgtgggagaagccctaccaaggctggatgatggtagattgtacttgcctgggagaaggcagcggacgcatcacttgcacttctagaaatagatgcaacgatcaggacacaaggacatcctatagaattggagacacctggagcaagaaggataatcgaggaaacctgctccagtgcatctgcacaggcaacggccgaggagagtggaagtgtgagaggcacacctctgtgcagaccacatcgagcggatctggccccttcaccgatgttcgtgcagctgtttaccaaccgcagcctcacccccagcctcctccctatggccactgtgtcacagacagtggtgtggtctactctgtggggatgcagtggctgaagacacaaggaaataagcaaatgctttgcacgtgcctgggcaacggagtcagctgccaagagacagctgtaacccagacttacggtggcaactcaaatggagagccatgtgtcttaccattcacctacaatggcaggacgttctactcctgcaccacagaagggcgacaggacggacatctttggtgcagcacaacttcgaattatgagcaggaccagaaatactctttctgcacagaccacactgttttggttcagactcgaggaggaaattccaatggtgccttgtgccacttccccttcctatacaacaaccacaattacactgattgcacttctgagggcagaagagacaacatgaagtggtgtgggaccacacagaactatgatgccgaccagaagtttgggttctgccccatggctgcccacgaggaaatctgcacaaccaatgaaggggtcatgtaccgcattggagatcagtgggataagcagcatgacatgggtcacatgatgaggtgcacgtgtgttgggaatggtcgtggggaatggacatgcattgcctactcgcagcttcgagatcagtgcattgttgatgacatcacttacaatgtgaacgacacattccacaagcgtcatgaagaggggcacatgctgaactgtacatgcttcggtcagggtcggggcaggtggaagtgtgatcccgtcgaccaatgccaggattcagagactgggacgttttatcaaattggagattcatgggagaagtatgtgcatggtgtcagataccagtgctactgctatggccgtggcattggggagtggcattgccaacctttacagacctatccaagctcaagtggtcctgtcgaagtatttatcactgagactccgagtcagcccaactcccaccccatccagtggaatgcaccacagccatctcacatttccaagtacattctcaggtggagacctaaaaattctgtaggccgttggaaggaagctaccataccaggccacttaaactcctacaccatcaaaggcctgaagcctggtgtggtatacgagggccagctcatcagcatccagcagtacggccaccaagaagtgactcgctttgacttcaccaccaccagcaccagcacacctgtgaccagcaacaccgtgacaggagagacgactcccttttctcctcttgtggccacttctgaatctgtgaccgaaatcacagccagtagctttgtggtctcctgggtctcagcttccgacaccgtgtcgggattccgggtggaatatgagctgagtgaggagggagatgagccacagtacctggatcttccaagcacagccacttctgtgaacatccctgacctgcttcctggccgaaaatacattgtaaatgtctatcagatatctgaggatggggagcagagtttgatcctgtctacttcacaaacaacagcgcctgatgcccctcctgacccgactgtggaccaagttgatgacacctcaattgttgttcgctggagcagaccccaggctcccatcacagggtacagaatagtctattcgccatcagtagaaggtagcagcacagaactcaaccttcctgaaactgcaaactccgtcaccctcagtgacttgcaacctggtgttcagtataacatcactatctatgctgtggaagaaaatcaagaaagtacacctgttgtcattcaacaagaaaccactggcaccccacgctcagatacagtgccctctcccagggacctgcagtttgtggaagtgacagacgtgaaggtcaccatcatgtggacaccgcctgagagtgcagtgaccggctaccgtgtggatgtgatccccgtcaacctgcctggcgagcacgggcagaggctgcccatcagcaggaacacctttgcagaagtcaccgggctgtcccctggggtcacctattacttcaaagtctttgcagtgagccatgggagggagagcaagcctctgactgctcaacagacaaccaaactggatgctcccactaacctccagtttgtcaatgaaactgattctactgtcctggtgagatggactccacctcgggcccagataacaggataccgactgaccgtgggccttacccgaagaggacagcccaggcagtacaatgtgggtccctctgtctccaagtacccactgaggaatctgcagcctgcatctgagtacaccgtatccctcgtggccataaagggcaaccaagagagccccaaagccactggagtctttaccacactgcagcctgggagctctattccaccttacaacaccgaggtgactgagaccaccattgtgatcacatggacgcctgctccaagaattggttttaagctgggtgtacgaccaagccagggaggagaggcaccacgagaagtgacttcagactcaggaagcatcgttgtgtccggcttgactccaggagtagaatacgtctacaccatccaagtcctgagagatggacaggaaagagatgcgccaattgtaaacaaagtggtgacaccattgtctccaccaacaaacttgcatctggaggcaaaccctgacactggagtgctcacagtctcctgggagaggagcaccaccccagacattactggttatagaattaccacaacccctacaaacggccagcagggaaattctttggaagaagtggtccatgctgatcagagctcctgcacttttgataacctgagtcccggcctggagtacaatgtcagtgtttacactgtcaaggatgacaaggaaagtgtccctatctctgataccatcatcccagaggtgccccaactcactgacctaagctttgttgatataaccgattcaagcatcggcctgaggtggaccccgctaaactcttccaccattattgggtaccgcatcacagtagttgcggcaggagaaggtatccctatttttgaagattttgtggactcctcagtaggatactacacagtcacagggctggagccgggcattgactatgatatcagcgttatcactctcattaatggcggcgagagtgcccctactacactgacacaacaaacggctgttcctcctcccactgacctgcgattcaccaacattggtccagacaccatgcgtgtcacctgggctccacccccatccattgatttaaccaacttcctggtgcgttactcacctgtgaaaaatgaggaagatgttgcagagttgtcaatttctccttcagacaatgcagtggtcttaacaaatctcctgcctggtacagaatatgtagtgagtgtctccagtgtctacgaacaacatgagagcacacctcttagaggaagacagaaaacaggtcttgattccccaactggcattgacttttctgatattactgccaactcttttactgtgcactggattgctcctcgagccaccatcactggctacaggatccgccatcatcccgagcacttcagtgggagacctcgagaagatcgggtgccccactctcggaattccatcaccctcaccaacctcactccaggcacagagtatgtggtcagcatcgttgctcttaatggcagagaggaaagtcccttattgattggccaacaatcaacagtttctgatgttccgagggacctggaagttgttgctgcgacccccaccagcctactgatcagctgggatgctcctgctgtcacagtgagatattacaggatcacttacggagagacaggaggaaatagccctgtccaggagttcactgtgcctgggagcaagtctacagctaccatcagcggccttaaacctggagttgattataccatcactgtgtatgctgtcactggccgtggagacagccccgcaagcagcaagccaatttccattaattaccgaacagaaattgacaaaccatcccagatgcaagtgaccgatgttcaggacaacagcattagtgtcaagtggctgccttcaagttcccctgttactggttacagagtaaccaccactcccaaaaatggaccaggaccaacaaaaactaaaactgcaggtccagatcaaacagaaatgactattgaaggcttgcagcccacagtggagtatgtggttagtgtctatgctcagaatccaagcggagagagtcagcctctggttcagactgcagtaaccaacattgatcgccctaaaggactggcattcactgatgtggatgtcgattccatcaaaattgcttgggaaagcccacaggggcaagtttccaggtacagggtgacctactcgagccctgaggatggaatccatgagctattccctgcacctgatggtgaagaagacactgcagagctgcaaggcctcagaccgggttctgagtacacagtcagtgtggttgccttgcacgatgatatggagagccagcccctgattggaacccagtccacagctattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggtggccaccaaatatgaagtgagtgtctatgctcttaaggacactttgacaagcagaccagctcagggagttgtcaccactctggagaatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtttacaaccaggcactgactacaagatctacctgtacaccttgaatgacaatgctcggagctcccctgtggtcatcgacgcctccactgccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaaccgaatatacaatttatgtcattgccctgaagaataatcagaagagcgagcccctgattggaaggaaaaagacagacgagcttccccaactggtaacccttccacaccccaatcttcatggaccagagatcttggatgttccttccacagttcaaaagacccctttcgtcacccaccctgggtatgacactggaaatggtattcagcttcctggcacttctggtcagcaacccagtgttgggcaacaaatgatctttgaggaacatggttttaggcggaccacaccgcccacaacggccacccccataaggcataggccaagaccatacccgccgaatgtaggtgaggaaatccaaattggtcacatccccagggaagatgtagactatcacctgtacccacacggtccgggactcaatccaaatgcctctacaggacaagaagctctctctcagacaaccatctcatgggccccattccaggacacttctgagtacatcatttcatgtcatcctgttggcactgatgaagaacccttacagttcagggttcctggaacttctaccagtgccactctgacaggcctcaccagaggtgccacctacaacatcatagtggaggcactgaaagaccagcagaggcataaggttcgggaagaggttgttaccgtgggcaactctgtcaacgaaggcttgaaccaacctacggatgactcgtgctttgacccctacacagtttcccattatgccgttggagatgagtgggaacgaatgtctgaatcaggctttaaactgttgtgccagtgcttaggctttggaagtggtcatttcagatgtgattcatctagatggtgccatgacaatggtgtgaactacaagattggagagaagtgggaccgtcagggagaaaatggccagatgatgagctgcacatgtcttgggaacggaaaaggagaattcaagtgtgaccctcatgaggcaacgtgttatgatgatgggaagacataccacgtaggagaacagtggcagaaggaatatctcggtgccatttgctcctgcacatgctttggaggccagcggggctggcgctgtgacaactgccgcagacctgggggtgaacccagtcccgaaggcactactggccagtcctacaaccagtattctcagagataccatcagagaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattccacaacttgaagttcatctatttgatataagacaccttcgggggaaataattcctgtgaatattctttttcaattcagcaaacatttgaaaatctatgatgtgcaagtctaattgttgatttcagtacaagattttctaaatcagttgctacaaaaactgattggtttttgtcacttcatctcttcactaatggagatagctttacactttctgctttaatagatttaagtggaccccaatatttattaaaattgctagtttaccgttcagaagtataatagaaataatctttagttgctcttttctaaccattgtaattcttcccttcttccctccacctttccttcattgaataaacctctgttcaaagagattgcctgcaagggaaataaaaatgactaagatattaaaaaaaaaaaaaaaaaa

SEQ ID NO: 5676 - DNA, 1182 bp, Homo sapiens
gcggccgcaccccccggccgggccgtgcttctgcccctacaaggtttgggccgaggtgggggagggtcctggttgccggccccgcccggtccctccccgccttttaggcgcccgcgtggccgggacgtcccagtcccgctccgtcctcctcgcctgccaccggtgcacccagtccgctcacccagcccagtccgtccggtcctcaccgcctgccggccggcccaccccccaccgcagccatggacgccatcaagaagaagatgcagatgctgaagctggacaaggagaacgccatcgaccgcgccgagcaggccgaagccgacaagaagcaagctgaggaccgctgcaagcagctggaggaggagcagcaggccctccagaagaagctgaaggggacagaggatgaggtggaaaagtattctgaatccgtgaaggaggcccaggagaaactggagcaggccgagaagaaggccactgatgctgaggcagatgtggcctccctgaaccgccgcattcagctggttgaggaggagctggaccgggcccaggagcgcctggctacagccctgcagaagctggaggaggccgagaaggcggctgatgagagcgagagaggaatgaaggtcatcgaaaaccgggccatgaaggatgaggagaagatggaactgcaggagatgcagctgaaggaggccaagcacatcgctgaggattcagaccgcaaatatgaagaggtggccaggaagctggtgatcctggaaggagagctggagcgctcggaggagagggctgaggtggccgagagccgagccagacagctggaggaggaacttcgaaccatggaccaggccctcaagtccctgatggcctcagaggaggagtattccaccaaagaagataaatatgaagaggagatcaaactgttggaggagaagctgaaggaggctgagacccgagcagagtttgccgagaggtctgtggcaaagttggagaaaaccatcgatgacctagaagagaccttggccagtgccaaggaggagaacgtcgagattcaccagaccttggaccagaccctgctggaactcaacaacctgtgagggccagccccacccccagccaggctatggttgccaccccaacccaataaaactgatgttactagcctctcaaggccctttaatcctt

SEQ ID NO: 5677 - DNA, 8669 bp, Homo sapiens
gatttttctgtagttagagggaaacacaaaacgaagagcggcccactcccagcttacgccgatggtgagcccacctctcctgatcattagcgttgctggcacaattgaatgcaagccagatcatctcttatggagacccggcagtacctcacctcagtctgtgagttttctccatgggaaggttgtgatggagtctctgggccctccgaaccaccacagccagtcgactctgaggccccctctcccaccccctcacaaccacacgctgtcccatcaccactcgtccgccaactccctcaacaggaactcactgaccaatcggcggagtcagatccacgccccggccccagcgcccaatgacctggccaccacaccagagtccgttcagcttcaggacagctgggtgctaaacagcaacgtgccactggagacccggcacttcctcttcaagacctcctcggggagcacacccttgttcagcagctcttccccgggataccctttgacctcaggaacggtttacacgcccccgccccgcctgctgcccaggaatactttctccaggaaggctttcaagctgaagaagccctccaaatactgcagctggaaatgtgctgccctctccgccattgccgcggccctcctcttggctattttgctggcgtatttcatagcaatgcatctgctcggactcaattggcaactccagcctgcagatgggcacacctttaacaatgggataaggaccggcttaccaggaaacgatgatgtggcaacaatgccatctggaggcaaagtgccctggtcgttgaaaaacagcagcatagacagtggtgaagcagaagttggtcggcgggtaacacaagaagtcccaccaggggtgttttggaggtcacaaattcacatcagtcagccccagttcttaaagttcaacatctccctcgggaaggacgctctctttggtgtttacataagaagaggacttccaccatctcatgcccagtatgacttcatggaacgtctggacgggaaggagaagtggagtgtggttgagtctcccagggaacgccggagcatacagaccttggttcagaatgaagccgtgtttgtgcagtacctggatgtgggcctgtggcatctggccttctacaatgatggaaaagacaaagagatggtttccttcaatactgttgtcctgacacgggcctctgcagctgcgatcccaactggatgggtcccgactgctctgttgaagtgtgctcagtagactgtggcactcacggcgtctgcatcgggggagcctgccgctgtgaagagggctggacaggcgcagcgtgtgaccagcgcgtgtgccacccccgctgcattgagcacgggacctgtaaagatggcaaatgtgaatgccgagagggctggaatggtgaacactgcaccattgatggctgccctgacttgtgcaacggtaacgggagatgcacactgggtcagaacagctggcagtgtgtctgccagaccggctggagagggcccggatgcaacgttgccatggaaacttcctgtgctgataacaaggataatgagggagatggcctggtggattgtttggaccctgactgctgcctgcagtcagcctgtcagaacagcctgctctgccgggggtcccgggacccactggacatcattcagcagggccagacggattggcccgcagtgaagtccttctatgaccgtatcaagctcttggcaggcaaggatagcacccacatcattcctggagagaaccctttcaacagcagcttggtttctctcatccgaggccaagtagtaactacagatggaactcccctggtcggtgtgaacgtgtcttttgtcaagtacccaaaatacggctacaccatcacccgccaggatggcacgttcgacctgatcgcaaatggaggtgcttccttgactctacactttgagcgagccccgttcatgagccaggagcgcactgtgtggctgccgtggaacagcttttacgccatggacaccctggtgatgaagaccgaggagaactccatccccagctgtgacctcagtggctttgtccggcctgatccaatcatcatctcctccccactgtccaccttctttagtgctgcccctgggcagaatcccatcgtgcctgagacccaggttcttcatgaagaaatcgagctccctggttccaatgtgaaacttcgctatctgagctctagaactgcagggtacaagtcactgctgaagatcaccatgacccagtccacagtgcccctgaacctcattagggttcacctgatggtggctgtcgaggggcatctcttccagaagtcattccaggcttctcccaacctggcctacaccttcatctgggacaagacagatgcgtatggccaaagggtgtatggactctcagatgctgttgtgtctgtcgggtttgaatatgagacctgtcccagtctaattctctgggagaaaaggacagccctccttcagggattcgagctggacccctccaacctcggtggctggtccctagacaaacaccacatcctcaatgttaaaagtggaatcctacacaaaggcactggggaaaaccagttcctgacccagcagcctgccatcatcaccagcatcatgggcaatggtcgccgccggagcatttcctgtcccagctgcaacggccttgctgaaggcaacaagctgctggccccagtggctctggctgttggaatcgatgggagcctctatgtgggtgacttcaattacatccgacgcatctttccctctcgaaatgtgaccagcatcttggagttacgcaacaacccagcacacaagtactacttggcagtggaccccgtgtccggctcgctctacgtgtccgacaccaacagcaggagaatctaccgcgtcaagtctctgagtggaaccaaagacctggctgggaattcggaagttgtggcagggacgggagagcagtgtctaccctttgatgaagcccgctgcggggatggagggaaggccatagatgcaaccctgatgagcccgagaggtattgcagtagacaagaatgggctcatgtactttgtcgatgccaccatgatccggaaggttgaccagaatggaatcatctccaccctgctgggctccaatgacctcactgccgtccggccgctgagctgtgattccagcatggatgtagcccaggttcgtctggagtggccaacagaccttgctgtcaatcccatggataactccttgtatgttctagagaacaatgtcatccttcgaatcaccgagaaccaccaagtcagcatcattgcgggacgccccatgcactgccaagttcctggcattgactactcactcagcaaactagccattcactctgccctggagtcagccagtgccattgccatttctcacactggggtcctctacatcactgagacagatgagaagaagattaaccgtctacgccaggtaacaaccaacggggagatctgccttttagctggggcagcctcggactgcgactgcaaaaacgatgtcaattgcaactgctattcaggagatgatgcctacgcgactgatgccatcttgaattccccatcatccttagctgtagctccagatggtaccatttacattgcagaccttggaaatattcggatcagggcggtcagcaagaacaagcctgttcttaatgccttcaaccagtatgaggctgcatcccccggagagcaggagttatatgttttcaacgctgatggcatccaccaatacactgtgagcctggtgacaggggagtacttgtacaatttcacatatagtactgacaatgatgtcactgaattgattgacaataatgggaattccctgaagatccgtcgggacagcagtggcatgccccgtcacctgctcatgcctgacaaccagatcatcaccctcaccgtgggcaccaatggaggcctcaaagtcgtgtccacacagaacctggagcttggtctcatgacctatgatggcaacactgggctcctggccaccaagagcgatgaaacaggatggacgactttctatgactatgaccacgaaggccgcctgaccaacgtgacgcgccccacgggggtggtaaccagtctgcaccgggaaatggagaaatctattaccattgacattgagaactccaaccgtgatgatgacgtcactgtcatcaccaacctctcttcagtagaggcctcctacacagtggtacaagatcaagttcggaacagctaccagctctgtaataatggtaccctgagggtgatgtatgctaatgggatgggtatcagcttccacagcgagccccatgtcctagcgggcaccatcacccccaccattggacgctgcaacatctccctgcctatggagaatggcttaaactccattgagtggcgcctaagaaaggaacagattaaaggcaaagtcaccatctttggcaggaagctccgggtccatggaagaaatctcttgtccattgactatgatcgaaatattcggactgaaaagatctatgatgaccaccggaagttcaccctgaggatcatttatgaccaggtgggccgccccttcctctggctgcccagcagcgggctggcagctgtcaacgtgtcatacttcttcaatgggcgcctggctgggcttcagcgtggggccatgagcgagaggacagacatcgacaagcaaggccgcatcgtgtcccgcatgttcgctgacgggaaagtgtggagctactcctaccttgacaagtccatggtcctcctgcttcagagccaacgtcagtatatatttgagtatgactcctctgaccgcctccttgccgtcaccatgcccagcgtggcccggcacagcatgtccacacacacctccatcggctacatccgtaatatttacaacccgcctgaaagcaatgcttcggtcatctttgactacagtgatgacggccgcatcctgaagacctcctttttgggcaccggacgccaggtgttctacaagtatgggaaactctccaagttatcagagattgtctacgacagtaccgccgtcaccttcgggtatgacgagaccactggtgtcttgaagatggtcaacctccaaagtgggggcttctcctgcaccatcaggtaccggaagattggccccctggtggacaagcagatctacaggttctccgaggaaggcatggtcaatgccaggtttgactacacctatcatgacaacagcttccgcatcgcaagcatcaagcccgtcataagtgagactcccctccccgttgacctctaccgctatgatgagatttctggcaaggtggaacactttggtaagtttggagtcatctattatgacatcaaccagatcatcaccactgccgtgatgaccctcagcaaacacttcgacacccatgggcggatcaaggaggtccagtatgagatgttccggtccctcatgtactggatgacggtgcaatatgacagcatgggcagggtgatcaagagggagctaaaactggggccctatgccaataccacgaagtacacctatgactacgatggggacgggcagctccagagcgtggccgtcaatgaccgcccgacctggcgctacagctatgaccttaatgggaatctccacttactgaacccaggcaacagtgtgcgcctcatgcccttgcgctatgacctccgggatcggataaccagactcggggatgtgcagtacaaaattgacgacgatggctatctgtgccagagagggtctgacatcttcgaatacaattccaagggcctcctaacaagagcctacaacaaggccagcgggtggagtgtccagtaccgctatgatggcgtaggacggcgggcttcctacaagaccaacctgggccaccacctgcagtacttctactctgacctccacaacccgacgcgcatcacccatgtctacaatcactccaactcggagattacctcactgtactacgacctccagggccacctctttgccatggagagcagcagtggggaggagtactatgttgcctctgataacacagggactcctctggctgtgttcagcatcaacggcctcatgatcaaacagctgcagtacacggcctatggggagatttattatgactccaaccccgacttccagatggtcattggcttccatgggggactctatgaccccctgaccaagctggtccacttcactcagcgtgattatgatgtgctggcaggacgatggacctccccagactataccatgtggaaaaacgtgggcaaggagccggccccctttaacctgtatatgttcaagagcaacaatcctctcagcagtgagctagatttgaagaactacgtgacagatgtgaaaagctggcttgtgatgtttggatttcagcttagcaacatcattcctggcttcccgagagccaaaatgtatttcgtgcctcctccctatgaattgtcagagagtcaagcaagtgagaatggacagctcattacaggtgtccaacagacaacagagagacataaccaggccttcatggctctggaaggacaggtcattactaaaaagctccacgccagcatccgagagaaagcaggtcactggtttgccaccaccacgcccatcattggcaaaggcatcatgtttgccatcaaagaagggcgggtgaccacgggcgtgtccagcatcgccagcgaagatagccgcaaggtggcatctgtgctgaacaacgcctactacctggacaagatgcactacagcatcgagggcaaggacacccactactttgtgaagattggctcagccgatggcgacctggtcacactaggcaccaccatcggccgcaaggtgctagagagcggggtgaacgtgaccgtgtcccagcccacgctgctggtcaacggcaggactcgaaggttcacgaacattgagttccagtactccacgctgctgctcagcatccgctatggcctcacccccgacaccctggacgaagagaaggcccgcgtcctggaccaggcgagacagagggccctgggcacggcctgggccaaggagcagcagaaagccagggacgggagagaggggagccgcctgtggactgagggcgagaagcagcagcttctgagcaccgggcgcgtgcaagggtacgagggatattacgtgcttcccgtggagcaatacccagagcttgcagacagtagcagcaacatccagtttttaagacagaatgagatgggaaagaggtaacaaaataatctgctgccattccttgtctgaatggctcagcaggagtaactgttatctcctctcctaaggagatgaagacctaacaggggcactgcggctgggctgctttaggagaccaagtggcaagaaagctcacattttttgagttcaaatgctactgtccaagcgagaagtccctcatcctgaagtagactaaagcccggctgaaaattccgaggaaaacaaaacaaacgaatgaatgaacagacacacacaatgttccaagttcccctaaaatatgacccacttgttctgggtctacgcagaaaagagacgcaaagtgtccaaaaggaacaaaagaacaaaaacgaataagcaaagaagaaaacaaacaaaaacaaaacaaaacaaacacacggaccaataaacaaagaagcgaagataagaaagaaggcctcatatccaattacctcactcattcacatgtgagcgacacgcagacatccgcgagggccagcgtcaccagaccagctgcgggacaaaccactcagactgcttgtaggacaaatacttctgacattttcgtttaagcaaatacaggtgcatttaaaacacgactttgggggtgatttgtgtgtagcgcctggggaggggggataaaagaggaggagtgagcactggaaatactttttaaagaaaaaaaaacatgagggaataaaagaaattcctatcaaaaatcaaagtgaaataataccatccagcacttaactctcaggtcccaactaagtctggcctgagctaatttatttgagcgcagagtgtaaaatttaattcaaaatggtggctataatcactacagataaatttcatactcttttgtctttggagattccattgtggacagtaatacgcagttacagggtgtagtctgtttagattccgtagttcgtgggtatcagtttcggtagaggtgcagcatcgtgacacttttgctaacaggtaccacttctgatcaccctgtacatacatgagccgaaaggcacaatcactgtttcagatttaaaattattagtgtgtttgtttggtccagaaactgagacaatcacatgacagtcaccacgaggagagaaaatttaaaaaataaaaataaaaacaaaaaaaattttaaaaattaaaaaaacaaaaataaagtctaataagaactttggtacaggaacttttttgtaatatacatgtatgaattgttcatcgagtttttatattaattttaatttgctgctaagcaaagactagggacaggcaaagataatttatggcaaagtgtttaaattgtttatacataaataaagtctctaaaactcctgtggaca

SEQ ID NO: 5678 - DNA, 5071 bp, Homo sapiens
gtattttaggcgccattttcgagtgaaggacccggagccgaaacaccggtaggagcggggaggtgggtactacacaaccgtctccagccttggtctgagtggactgtcctgcagcgaccatgccccgtaaaggcacccagccctccactgcccggcgcagagaggaagggccgccgccgccgtcccctgacggcgccagcagcgacgcggagcctgagccgccgtccggccgcacggagagcccagccaccgccgcagcaatgaccaatgaagctggagctcctcggcttatgataactcatattgtaaaccagaacttcaaatcctatgctggggagaaaattctgggacctttccataagcgcttttcctgtattatcgggccaaatggcagtggcaaatccaatgttattgattctatgctttttgtgtttggctatcgagcacaaaaaataagatctaaaaaactctcagtattaatacataattctgatgaacacaaggacattcagagttgtacagtagaagttcattttcaaaagataattgataaggaaggggatgattatgaagtcattcctaacagtaatttctatgtatccagaacggcctgcagagataatacttctgtctatcacataagtggaaagaaaaagacatttaaggatgttggaaatcttcttcgaagccatggaattgacttggaccataatagatttttaattttacagggtgaagttgaacaaattgctatgatgaaaccaaaaggccagactgaacacgatgagggtatgcttgaatatttagaagatataattggttgtggacggctaaatgaacctattaaagtcttgtgtcggagagttgaaatattaaatgaacacagaggagagaagttaaacagggtaaagatggtggaaaaggaaaaggatgccttagaaggagagaaaaacatagctatcgaatttcttaccttggaaaatgaaatatttagaaaaaagaatcatgtttgtcaatattatatttatgagttgcagaaacgaattgctgaaatggaaactcaaaaggaaaaaattcatgaagataccaaagaaattaatgagaagagcaatatactatcaaatgaaatgaaagctaagaataaagatgtaaaagatacagaaaagaaactgaataaaattacaaaatttattgaggagaataaagaaaaatttacacagctagatttggaagatgttcaagttagagaaaagttaaaacatgccacgagtaaagccaaaaaactggagaaacaacttcaaaaagataaagaaaaggttgaagaatttaaaagtatacctgccaagagtaacaatatcattaatgaaacaacaaccagaaacaatgccctcgagaaggaaaaagagaaagaagaaaaaaaattaaaggaagttatggatagccttaaacaggaaacacaagggcttcagaaagaaaaagaaagtcgagagaaagaacttatgggtttcagcaaatcggtaaatgaagcacgttcaaagatggatgtagcccagtcagaacttgatatctatctcagtcgtcataatactgcagtgtctcaattaactaaggctaaggaagctctaattgcagcttctgagactctcaaagaaaggaaagctgcaatcagagatatagaaggaaaactccctcaaactgaacaagaattaaaggagaaagaaaaagaacttcaaaaacttacacaagaagaaacaaactttaaaagtttggttcatgatctctttcaaaaagttgaagaagcaaagagctcattagcaatgaatcgaagtagggggaaagtccttgatgcaataattcaagaaaaaaaatctggcaggattccaggaatatatggaagattgggggacttaggagccattgatgaaaaatacgacgtggctatatcatcctgttgtcatgcactggactacattgttgttgattctattgatatagcccaagaatgtgtaaacttccttaaaagacaaaatattggagttgcaacctttataggtttagataagatggctgtatgggcgaaaaagatgaccgaaattcaaactcctgaaaatactcctcgtttatttgatttagtaaaagtaaaagatgagaaaattcgccaagctttttattttgctttacgagataccttagtagctgacaacttggatcaagccacaagagtagcatatcaaaaagatagaagatggagagtggtaactttacagggacaaatcatagaacagtcaggtacaatgactggtggtggaagcaaagtaatgaaaggaagaatgggttcctcacttgttattgaaatctctgaagaagaggtaaacaaaatggaatcacagttgcaaaacgactctaaaaaagcaatgcaaatccaagaacagaaagtacaacttgaagaaagagtagttaagttacggcatagtgaacgagaaatgaggaacacactagaaaaatttactgcaagcatccagcgtttaatagagcaagaagaatatttgaatgtccaagttaaggaacttgaagctaatgtacttgctacagcccctgacaaaaaaaagcagaaattgctagaagaaaacgttagtgctttcaaaacagaatatgatgctgtggctgagaaagctggtaaagtagaagctgaggttaaacgcttacacaataccatcgtagaaatcaataatcataaactcaaggcccaacaagacaaacttgataaaataaataagcaattagatgaatgtgcttctgctattactaaagcccaagtagcaatcaagactgctgacagaccttcaaaaggcacaagactctgtcttgcgtacagagaaagaaataaaagatactgagaaagaggtggatgacctaacagcagagctgaaaagtcttgaggacaaagcagcagaggtcgtaaagaatacaaatgctgcagaggaatccttaccagagatccagaaagaacatcgcaatctgcttcaagaattaaaagttattcaagaaaatgaacatgctcttcaaaaagatgcacttagtattaagttgaaacttgaacaaatagatggtcacattgctgaacataattctaaaataaaatattggcacaaagagatttcaaaaatatcactgcatcctatagaagataatcctattgaagagatttcggttctaagcccagaggatcttgaagcgatcaagaatccagattctataacaaatcaaattgcacttttggaagcccggtgtcatgaaatgaaaccaaacctcggtgccatcgcagagtataaaaagaaggaagaattgtatttgcaacgggtagcagaattggacaaaattacttatgaaagagacagttttagacaggcatatgaagatcttcggaaacaaaggcttaatgaatttatggcaggtttttatataataacaaataaattaaaggaaaattaccaaatgcttactttgggaggggacgccgaactcgagcttgtagacagcttggatcctttctctgaaggaatcatgttcagtgttcgaccacctaagaaaagttggaaaaagatcttcaacctttcgggaggagagaaaacacttagttcattggctttagtatttgctcttcaccactacaagcccactcccctttacttcatggatgagattgatgcagcccttgattttaaaaatgtgtccattgttgcattttatatatatgaacaaacaaaaaatgcacagttcataataatttctcttcgaaataatatgtttgagatttcggatagacttattggaatttacaagacatacaacataacaaaaagtgttgctgtaaatccaaaagaaattgcatctaagggactttgttgaactttatgctgaagattcttcaagttgattcagtgtattactgatttttttctatttgtaaaggattatgagttgtataaaatacatactccctaaactagatcatgaaactggtttctgttttatgcagttgtcatttgtaaagtctaataaaatattctctataattgcttctagattacaaaaatatgacaatcttgtaagtagcagactatggagaaaaatgagttacctggagggtcaggtaacttgccaaactaaaaagtatgttagttgaggcaaagtcctaagcaaggttgtgctatcaaggctcagcataccttcgtgggcctttgatttaccaacactggaaatgcctgccaactaatcttggatagattctttaaggcattccacttagcttgccagttgagacaatcaccacagttattacccaaatactatgaacatatttttgtaaaccagtcattctgaattatagtgatgagaatttaaatatatgcttttctagaatttgatgtttgaccatttatgacttaattaccagagagccagtaaattaggacagtgtttcaacaagcctaggctatctcgtaagttgaaaaatatcccactatagttgcttcatgagtatgaagtaagatggcctctgatttacactggttcaatttacaaattttcaactttatgataggtttatccgggtactaaatgcatttcaacttgatagtttcaacttatgataggtttaccaggatgtagtcccactgttgaggagcatctatttaggggttaattactttagtaataagtggaaagtaagataccttgagtaatgtttgcctataaaattgtcagcgtatttttacactattggctcaagaatgttataatgctaagggacataagttggcaaccacttggtttttggaaggactttcggtattgtattagaagtctgccctagctgttaaatttctgggtatttatcctaaggaattaattaaagagttaattgttcctttcttcagtgggccattgttttagatatttaaaaaatccaacagtttctatcataatgtaactgtaaaaatgtaaacacattattagcatggacttttaaataaagatttaaagaaagcaaaaaaaaaaaaaaaaaaaa

SEQ ID NO: 5679 - DNA, 1933 bp, Homo sapiens
gattgtgggaaggcagctgaactcggcgcctggaaagatggaggcagcggagacagaggcggaagctgcagccctagaggtcctggctgaggtggcaggcatcttggaacctgtaggcctgcaggaggaggcagaactgccagccaagatcctggttgagtttgtggtggtatgtacaagatgagagcgagcctttcagaagccagggtctggtcctggctcctcttactgagatacagggcagcattggcagagagcagacttaaggaaacctgtaaggaggtaaggatgttccctgtctctgccctccctctgagcaggactctcagaagaaagacaagctgctctgcagccagcttcaggtagcggatttcctgcagaacatcctggctcaggaggacactgctaagggtctcgaccccttggcttctgaagacacgagccgtgagtaggcaggggattgtagtagcagctgacctgagtggggaaggaaggaggatttcagttaggtctcccatttggctgatgggaaggaggcccagtgttgcagggaggcaggctagcaggccaccctcactcatgtactcattcctggtggctcatctcaggacagaaggcaattgcagctaaggaacaatggaaagagctgaaggccacctacagggagcacgtagaggccatcaaaattggcctcaccaaggccctgactcagatggaggaagcccagaggaaacggacacaactccgggaagcctttgagcagctccaggccaagaaacaaatggccatggagaaacgcagagcagtccagaaccagtggcagctacaacaggagaagcatctgcagcatctggcggaggtttctgcagaggtgagggagcgtaagacagggactcagcaggagcttgacagggtgtttcagaaacttggaaacctgaagcagcaggcagaacaggagcgggacaagctgcagaggtatcagaccttcctccagcttctgtataccctgcagggtaagctgttgttccctgaggctgaggctgaggcagagaatcttccagatgataaaccccagcagccgactcgaccccaggagcagagtacaggagacaccatggggagagaccctggtgtgtccttcaaggctgttggtctacaacctgctggagatgtaaatttgccatgacttcctggaggacagcagcatggagaaagatcctagaaaaggcctctgacttccctcacctcccaaccatcattacaggaaagactgtgaactcctgagttcagcttgatttctgactacatcccagcaagctctggcatctgtggattaaaatccctggatctctctcagttgtgtatttgttcatcttcatatgctggcaggaacaactattaatacagatactcagaagccaataacatgacaggagctgggactggtttgaacacagggtgtgcagatggggagggggtactggccttgggcctcctatgatgcagacatggtgaatttaattcaaggaggaggagaatgttttaggcaggtggttatatgtgggaagataattttattcatggatccaaatgtttgttgagtcctttctttgtgctaaggttcttgcggtgaaccagaattataacagtgagctcatctgactgttttaggatgtacagcctagtgttaacattcttggtatctttttgtgccttatctaaaacatttctcgatcactggtttcagatgttcatttattatattcttttcaaagattcagagattggcttttgtcatccactattgtatgttttgtttcattgacctctagtgataccttgatctttcccactttctgttttcggattggagaagatgtaccttttttgtcaactcttacttttatcagatgatcaactcacgtatttggat

SEQ ID NO: 5680 - DNA, 990 bp, Homo sapiens
atgcagaggagtgagctgagcacctccagtgaaaagctgagggaaaaaggtgggcctgggaacaggctgaggctgaagtggcctccgtgaacggtaggatccagctggttgaagaggagctggactgtgctcaggagcgcctggccactgccctgcaaaagctggaagaagcgggaaaagctgctgatgagagtgagagagatacaaaggttattgaaatctgggccttaaaagatgaagaagatggaactccaggaaatccaactcaaagaagctaagcacattgcagatgaggcagatgggaagtatgaagaggtggcttgtaagttggtgatcattgaaggagacatgggatgcacagaggaacgagctgagctggcagagtcccgttgctgagagatggatgagcagatcagactgatggaccagaacctgaagtgtctgagtgcagctgaagaaaagtactctcaaaaagaagacaaatgtgaggaagagaggaagattcttactgataatcttaaggaggcagagacccatgctgagttggctgagagatcagtagccaagctggaaaagacaattgatgacttggaagataaactgaaatgcaccaaagaggaacacctctgtacacaaaggatgctggaccagactctgcttgacctgaatgagatgtagaatgccccagtcccaccctgctgctgctccttcctctgaccctgactccgcctgaggccagcctgcccgaagctgacctttacctgagggctgatcttcaattggaaggctgctttctcctctcaccaccccctcctcccctgcctctttttcaccaaactgtctctgcctcttcctggagattccagctgggctagaggctgagaacctttgcaaacaacatttaagggaatgtgagcccaatgcataatgtctttaaaaatcatgttgtgaaaaaaaaatacataatcacttctgaaaaaaaaaaaaaaa

SEQ ID NO: 5681 - DNA, 2196 bp, Homo sapiens
ctcctcacaggtgtgtctctagtcctcgtggttgcctgccccactccctgccgagacgcctgccagaaaggtcacctatcctgaaccccagcaagcctgaaacagctcagccaagcaccctgcgatggaagctgcagatgcctccaggagcaacgggtcgagcccagaagccagggatgcccggagcccgtcgggccccagtggcagcctggagaatggcaccaaggctgacggcaaggatgccaagaccaccaacgggcacggcggggaggcagctgagggcaagagcctgggcagcgccctgaagccaggggaaggtaggagcgccctgttcgcgggcaatgagtggcggcgacccatcatccagtttgtcgagtccggggacgacaagaactccaactacttcagcatggactctatggaaggcaagaggtcgccgtacgcagggctccagctgggggctgccaagaagccacccgttacctttgccgaaaagggcgagctgcgcaagtccattttctcggagtcccggaagcccacggtgtccatcatggagcccggggagacccggcggaacagctacccccgggccgacacgggccttttttcacggtccaagtccggctccgaggaggtgctgtgcgactcctgcatcggcaacaagcagaaggcggtcaagtcctgcctggtgtgccaggcctccttctgcgagctgcatctcaagccccacctggagggcgccgccttccgagaccaccagctgctcgagcccatccgggactttgaggcccgcaagtgtcccgtgcatggcaagacgatggagctcttctgccagaccgaccagacctgcatctgctacctttgcatgttccaggagcacaagaatcatagcaccgtgacagtggaggaggccaaggccgagaaggagacggagctgtcactgcaaaaggagcagctgcagctcaagatcattgagattgaggatgaagctgagaagtggcagaaggagaaggaccgcatcaagagcttcaccaccaatgagaaggccatcctggagcagaacttccgggacctggtgcgggacctggagaagcaaaaggaggaagtgagggctgcgctggagcagcgggagcaggatgctgtggaccaagtgaaggtgatcatggatgctctggatgagagagccaaggtgctgcatgaggacaagcagacccgggagcagctgcatagcatcagcgactctgtgttgtttctgcaggaatttggtgcattgatgagcaattactctctccccccacccctgcccacctatcatgtcctgctggagggggagggcctgggacagtcactaggcaacttcaaggacgacctgctcaatgtatgcatgcgccacgttgagaagatgtgcaaggcggacctgagccgtaacttcattgagaggaaccacatggagaacggtggtgaccatcgctatgtgaacaactacacgaacagcttcgggggtgagtggagtgcaccggacaccatgaagagatactccatgtacctgacacccaaaggtggggtccggacatcataccagccctcgtctcctggccgcttcaccaaggagaccacccagaagaatttcaacaatctctatggcaccaaaggtaactacacctcccgggtctgggagtactcctccagcattcagaactctgacaatgacctgcccgtcgtccaaggcagctcctccttctccctgaaaggctatccctccctcatgcggagccaaagccccaaggcccagccccagacttggaaatctggcaagcagactatgctggtggtttaagcaaggtctgagcatccctcaagtcctgctgtggaccacacaaaggcaaggagctgaccaggaggtgtcagttccctgagagacagggccaaaggcagtgtacccttgagtctcactaccggccattctacgtcaacaaaggcaacgggattgggtccaacgaagccccatgagctcctggcggaagggtgctcaaggattggagaggagacaaaaccaggagcagcacagtggggacatctcccgtctcaacagccccaggcctatgggggctctggaaggatgggccagcttgcaggggttggggagggagacatccagcttgggctttcccctttggaataaaccattggtctgtc

SEQ ID NO: 5682 - DNA, 2450 bp, Homo sapiens
atatttcatacctttctagaaactgggtgtgatctcactgttggtaaagcccagcccttcccaacctgcaagctcaccttccaggactgggcccagcccatgctctccatatataagctgctgccccgagcctgattcctagtcctgcttctcttccctctctcctccagcctctcacactctcctcagctctctcatctcctggaaccatggccagcacatccaccaccatcaggagccacagcagcagccgccggggtttcagtgccaactcagccaggctccctggggtcagccgctctggcttcagcagcgtctccgtgtcccgctccaggggcagtggtggcctgggtggtgcatgtggaggagctggctttggcagccgcagtctgtatggcctggggggctccaagaggatctccattggagggggcagctgtgccatcagtggcggctatggcagcagagccggaggcagctatggctttggtggcgccgggagtggatttggtttcggtggtggagccggcattggctttggtctgggtggtggagccggccttgctggtggctttgggggccctggcttccctgtgtgcccccctggaggcatccaagaggtcaccgtcaaccagagtctcctgactcccctcaacctgcaaatcgatcccaccatccagcgggtgcgggctgaggagcgtgaacagatcaagaccctcaacaacaagtttgcctccttcatcgacaaggtgcggttcctggagcagcagaacaaggttctggaaacaaagtggaccctgctgcaggagcagggcaccaagactgtgaggcagaacctggagccgttgttcgagcagtacatcaacaacctcaggaggcagctggacagcattgtcggggaacggggccgcctggactcagagctcagaggcatgcaggacctggtggaggacttcaagaacaaatatgaggatgaaatcaacaagcgcacagcagcagagaatgaatttgtgactctgaagaaggatgtggatgctgcctacatgaacaaggttgaactgcaagccaaggcagacactctcacagacgagatcaacttcctgagagccttgtatgatgcagagctgtcccagatgcagacccacatctcagacacatctgtggtgctgtccatggacaacaaccgcaacctggacctggacagcatcatcgctgaggtcaaggcccaatatgaggagattgctcagagaagccgggctgaggctgagtcctggtaccagaccaagtacgaggagctgcaggtcacagcaggcagacatggggacgacctgcgcaacaccaagcaggagattgctgagatcaaccgcatgatccagaggctgagatctgagatcgaccacgtcaagaagcagtgcgccaacctgcaggccgccattgctgatgctgagcagcgtggggagatggccctcaaggatgccaagaacaagctggaagggctggaggatgccctgcagaaggccaagcaggacctggcccggctgctgaaggagtaccaggagctgatgaatgtcaagctggccctggacgtggagatcgccacctaccgcaagctgctggagggtgaggagtgcaggctgaatggcgaaggcgttggacaagtcaacatctctgtggtgcagtccaccgtctccagtggctatggcggtgccagtggtgtcggcagtggcttaggcctgggtggaggaagcagctactcctatggcagtggtcttggcgttggaggtggcttcagttccagcagtggcagagccattgggggtggcctcagctctgttggaggcggcagttccaccatcaagtacaccaccacctcctcctccagcaggaagagctataagcactaaagtgcgtctgctagctctcggtcccacagtcctcaggcccctctctggctgcagagccctctcctcaggttgcctttcctctcctggcctccagtctcccctgctgtcccaggtagagctgggtatggatgcttagtgccctcacttcttctctctctctctataccatctgagcacccattgctcaccatcagatcaacctctgattttacatcatgatgtaatcaccactggagcttcactgttactaaattattaatttcttgcctccagtgttctatctctgaggctgagcattataagaaaatgacctctgctccttttcattgcagaaaattgccaggggcttatttcagaacaacttccacttactttccactggctctcaaactctctaacttataagtgttgtgaacccccacccaggcagtatccatgaaagcacaagtgactagtcctatgatgtacaaagcctgtatctctgtgatgatttctgtgctcttcgctgtttgcaattgctaaataaagcagatttataatacaata

SEQ ID NO: 5683 - DNA, 5000 bp, Homo sapiens
aacatttttgaaagatcactcagctttaacacaccttggctgggtctggataaaaaaaaagtgagcactgcaaatttctagaagaaaacatcaggagaagaaagagagagggggatttattcaaagttgtttccaattccttcaaaacctcaaaccaggtggctatggtatggatgtaaccaagaaaaacaaacgagatggaactgaagtcactgagagaattgtcactgaaacagtaaccacaagacttacatccttaccaccaaaaggcgggaccagcaatggctatgctaaaacagcctctcttggtggagggagccggctggagaaacaaagcctgactcatggcagcagcggctacataaactcaactggaagcacacgaggccatgcctccacctctagttacaggagggctcactcacctgcctccactctgcccaactccccaggctcaacctttgaaaggaaaactcacgttacccgccatgcgtatgaagggagctccagtggcaactcttctccggagtaccctcggaaggaatttgcatcttcttcaaccagaggacggagtcaaacacgagagagtgaaattcgagttcgactgcagagtgcgtccccatccacccgatggacagaattggatgatgttaagcgtttgctcaaggggagtcgatcggcaagtgtgagccccacccggaattcctccaacacactccccatccccaagaaaggcactgtggagaccaaaattgtgacagcgagctcccagtcggtgtcaggcacctacgatgcaacgatcctggatgccaaccttccctcccatgtgtggtcctccaccctgcccgcggggtcctccatggggacctatcacaacaacatgacaacccagagctcatccctcctcaacaccaatgcctactctgcgggatcagtcttcggagttccaaacaacatggcgtcctgctcacccactttgcaccctggactcagcacatcctcctcagtgtttggcatgcagaacaatctggcccccagcttgaccaccctgtcccatggcaccaccaccacttccacagcatatggggtgaagaaaaacatgccccagagtcctgcggctgtgaacactggcgtttccacctccgccgcctgcaccacaagtgtgcagagcgatgaccttttgcacaaggactgcaagttcctgatcctagagaaagacaacacacctgctaagaaggagatggagctgctcatcatgaccaaggacagcgggaaggtctttacagcctcccctgccagcatcgctgcaacttctttttcagaagacaccctaaaaaaagaaaagcaagctgcctacaatgctgactcaggcctaaaagccgaagctaatggagacctgaagactgtgtccacaaagggcaagaccaccactgcagatatccacagctacagcagcagtggtggtggtggcagtggaggaggtggcggtgttggtggcgctggcggcggcccttggggaccagcgccagcctggtgcccctgcggctcctgctgcagctggtggaagtggctgctgggcctgctgctcacctggctgctactcctggggctgctcttcggcctcattgctctggcggaggaggtgaggaagctgaaggcgcgtgtggatgagctggagaggatcaggaggagcatactgccctatggggacagcatggatagaatagaaaaggaccgcctccagggcatggcacccgcggcgggagcagacctggacaaaattgggctgcacagtgacagccaggaggagctctggatgttcgtgaggaagaagctaatgatggaacaggaaaatggaaatctccgaggaagccctggccctaaaggtgacatgggaagtccaggccctaaaggagatcgagggttccctgggactccaggtatccctgggcccttgggccacccaggtccacaaggaccaaagggtcaaaaaggcagcgtgggagatcctggcatggaaggccccatgggccagagagggcgagaaggccccatgggacctcgtggtgaggcagggcctcctggatctggagagaaaggggaaagaggggctgctggtgaaccaggtcctcatggcccacctggtgtcccaggttctgtgggtcccaaaggttccagcggctctcctggcccacagggccctccaggtcctgtaggtctccaagggctccgaggtgaagtaggacttcctggtgtcaaaggtgacaaaggaccaatgggaccaccaggacccaaaggtgaccagggtgagaaaggacctcgaggcctcacaggcgagcctggcatgagaggtttgcctggtgctgttggtgagcccggggctaaaggagcaatgggtcctgctggcccagacggacaccaaggcccaagaggtgaacaaggtcttactgggatgcctggaatccgtggcccaccaggaccttctggagacccaggaaagccaggtctcacaggaccccagggacctcagggacttcccggtacccctggccgaccaggaataaaaggtgaaccaggagctccaggcaagatcgtgacttcggaggggtcatcgatgctcactgtcccaggccccccaggacctcctggagccatgggacccccaggacctccaggtgccccaggccctgccggcccagctggtctcccaggacatcaagaagttcttaatttacaaggtcccccaggcccacccggcccacgtgggccaccagggccttccattccaggcccaccaggaccccgaggcccaccaggggagggtttgccaggcccaccaggcccaccaggatcgttcctgtccaactcagaaaccttcctcttcggccccccaggcccacctggccccccaggtcccaagggagaccaaggtcccccaggccccagaggacaccaaggcgagcaaggcctcccaggtttctcaacctcagggtccagttctttcggactcaaccttcagggaccaccaggcccacctggcccccagggaccaaaaggtgacaaaggtgatccgggtgttccaggggctcttggcattcctagtggtccttctgaagggggatcatcaagtaccatgtacgtgtcaggcccgccagggccccctgggccccctgggcctccgggctctatcagcagctctggccaggagattcagcagtacatctctgagtacatgcagagtgacagtattagatcttacctatccggagttcagggtcccccaggcccacctggtcccccaggacctgtcaccaccatcacaggcgagactttcgactactcagagctggcaagccacgttgtgagctacttacggacttcggggtacggtgtcagcttgttctcgtcctccatctcttctgaagacatcctggctgtgctgcagcgggatgacgtgcgtcagtacctacgtcagtacttgatgggccctcggggtccgccagggccaccaggagccagtggagatgggtccctcctgtctttggactatgcagagctgagtagtcgcattctcagctacatgtcgagttctgggatcagcattgggcttcctggtcccccggggccccctggcttgccgggaacctcctatgaggagctcctctccttgctgcgagggtctgaattcagaggcatcgttggacccccaggtcccccgggtccaccagggatcccaggcaatgtgtggtccagcatcagcgtggaggacctctcgtcttacttacatactgccggcttgtcattcatcccaggccctccaggacctcctggtcccccagggcctcgagggcccccgggtgtctcaggagccctggcaacctatgcagctgaaaacagcgacagcttccggagcgagctgatcagctacctcacaagtcctgatgtgcgcagcttcattgttggccccccaggccctcctgggccgcagggaccccctggggacagccgcctcctgtccacggatgcctcccacagtcggggtagcagctcctcctcacacagctcatctgtcaggcggggcagctcctacagctcttccatgagcacaggaggaggtggtgcaggctccctgggtgcaggcggtgcctttggtgaagctgcaggagacaggggtccctatggcactgacatcggcccaggcggaggctatggggcagcagcagaaggcggcatgtatgctggcaatggcggactattgggagctgactttgctggagatctggattacaatgagctggctgtgagggtgtcagagagcatgcagcgtcagggcctactgcaagggatggcctacactgtccagggcccaccaggccagcctgggccacaggggccacccggcatcagcaaggtcttctctgcctacagcaacgtgactgcggacctcatggacttcttccaaacttatggagccattcaaggaccccctgggcaaaaaggagagatgggcactccaggacccaaaggtgacaggggccctgctgggccaccaggtcatcctgggccacctggccctcgaggacacaagggagaaaaaggagacaaaggtgaccaagtctatgctgggcggagaaggagaagaagtattgctgtcaagccgtgagctagccatggcaggacagctcctggaccaggcccatactagagttcatggatatgttatactgaaccaggccagagcaaacagaaaaagaaggttgagggcaatggacaaggaaggaataaagggagaagagggaaaacagaaaacctgatgctggggacacagcatcagctcaagacgtcaccctccattctgcactcagaaaatggcacttgggggactgggcgcagttggtctttaaccacttttcaatgtctaaaaacatttgtttgtggtctataagatgaaacatcatttcaatcgtaaaatttcccattaaagaagtttttttttctaa

SEQ ID NO: 5684 - DNA, 1931 bp, Homo sapiens
gcacgaagcatattaaggtagatatgttctatcgttaattgtagttttgacaggtggcatctcagtaatcaaaaggaagaaaatgaaccaaaagaaccaaagagggaaccattcatacttcaagatctctaataagaagtagcaatatttaatatggaatcaaaagcttgggaatcaaataatgaagatcttttatcaagtagtggtgtcacatctaatggaggttcttcaagttcattttttgtgtcatctattcgtggtacaataattgaaaacacatcttcagctgggactttgacacaggttccttttttccctaaatatgaagtggaacttgattctcctagaaaaatcatcccatctcctggaaaggaacactttgaacgtgttttggaagaatattcacatcaagtcaaagatttacagagaagactaaatgaaagcaatgaattgcatgagaaacaaaagttttatttgaggcagtcagtcattgatttgcaaacaaaacttcaggagatgcaaatggagagagatgctatggctgacatcagacgaagggagagtcagtcccaggaggatttaagaaatcagcttcaaaatacagttcatgaacttgaagctgccaaatgccttaaagaggacatgctgaaagacagcaacacacagatagagcaactacgaaaaatgatgcttagtcatgagggagtgcttcaagaaatccggtcaatcctagttgactttgaagaagcctcaggcaaaaaaatatgtgaacatgacagcatgtctactctgcacttccgcagcttgggctcagctattagtaaaatactaagagaattagacacagagatttcttatcttaaagggaggatatttccagtagaggatcaacttgaagcactgaaatctgaatcacagaacaaaatagaactacttctgcaacaacaccaagataggattgagcagttaataagtgaacatgaagttgaaataacaggacttactgagaaagctagcagtgctcgaagccaagccaatagtatccagagtcaaatggaaatcattcaagagcaagcaagaaaccaaaactctatgtatatgcgtcagctcagcgatctggaatctactgtttctcagctacgttctgaattaagggaagccaaaaggatgtatgaagacaagacagaagagctggaaaagcagttagtccttgccaactcagagctaactgaagcccggacagagcgtgatcaatccagcctgagatcagacatgtgccatagaagcaacaactcgttgagggactccactgaaggaagcaaatcaagtgaaactcttagtagagagccagtcacattacacgcaggagacagggaagatccctctggttgcttcacattcacatctgcagcaagtccatctgtgaaaaactcagcttctcgttcattcaattcttctcctaagaagtctccagtgcactcactcctaactagttcagttgaaggttcaataggttccacatcacagtatagatctgccaaacctattcattcatctgattctgttaaagattcacagtctccgccaatagaaacaacaggaaaaacatgcaggaagcttcagaacagactagaaagcttgcaaactctggtagaagatttacagctgaagaaccaagcaatgtcttcaatgatcagaaatcaagaaaagaggatacagaaagtaaaagaccaggaaaaaatgttactaaaatgactcgttgcttgcctattctttacagaggaatgaggcccaattaattgtggtgttactcgtaattagtgccctgtgtactttttctttttatgtgaaaatttaataaaagataccctgtcttgtaaactctattttgaaataaactattcttgaatccctcacagtaaaacttcaaa

SEQ ID NO: 5685 - DNA, 6320 bp, Homo sapiens
cacgtaaagggacagagattgggggacagaaggaagtgcattaattccttccacgacccctgaagagcagcggtgggtctgagcatcctatctccaggaagcaggccagcaggcaagccagctgccacctcgtcctgtgcaaagcacaggcaccgtccccaaaagatttccaaagatgatgttaaacccagccacggttctgatctccaggaaagcaattgctgtggtacaaaaggacaagggttaaaagagaacagtgggagctctctttcccagctaactcacgcagtgtgacgcagaggctttcagcacagcccagggtgcccgggactgaaaactccttcaccagccccctccacaggatatagaagacttagatcactacgagatgaaagcagagcccattagtgggaaaaagttggaggatgaaggaattgaaaaagaaaatttggcaatattagagaaattaggaagactgaaagacaagagcatttaactgcaaactgttgtcgttgtcaactgggttgtcttcctgaagtatgaatccggtatgtattgtgtggaggagcattacgtattgaacttctcacaaaacagggctgaagcagtgcctactcgacagaaccggtcatcgtacaaagaaatgccacgtgactcaaaggcaaagccagagtgcagcttggagcaaagaagatgatgtctcactctgtcacccaagatggagtgcaatggcacgatctcagctcactgcaacctctgcctcccaggttcaagcaattatcctgcctcagccacccgagtagctgagattacaggcctctgccaccatgctcagctattttttgtatttttagtagagacggggtttcaccatgttgggcaggctagtcttggaactactgacctcaggtgatccgcccactttggcctcccgaaagtgctgggattacagtcatgagccaccatgcccagcctatttatttctgattctttaagggtgactggatgtgttgatcagcgctcgctgggatttggctgacgtggccccagccccgcctccctccccaccccacaatggcagaagaaactggacagagtaaattagctgcagccaagaaaaagttcaaagaatattggcagagaaaccgccctggtgttccagcagcagcgaagaggaacacgaaagcaaatggcagtagccctgagacggccgcttctggtggttgccactcatctgaggctgtgagtcttgcctggacaggcttttggggacagggggcccaaggagcagtagagggcaatcgttaagattgtggatggactgttgggtactggtgaaggattctggatttggccgggcacagtggctcacgcctgtaatccccacacttcgggagaccgaggcaggtggatcacaaggtcaggagatcgagaccatccaggcaaacacggtgaaatactaaaaaatacaaaaaaaaaagccgggcgtggtggcgggcgcctgcagtcccagctgctccggagtctgagggaggagaatggcgtgaacctaggaggcggagcttgcagtgagccaagatcacgccactgcactccagcctggaaggcagagagagactccgtttcaaaaaagaaaagaattctgggtttgaatcctgcctctccgtctgctagggatatgatttagggcaagttgcttgagctctttgggcctctgttttcacgtctgtatgatagaggtggtattgtttgacttgtatttgtgaagtttcaatgagattgataattgtcgattttatgttaatccctagtacatggcctgctgtcaacacccaggacacccaggatatggtctttgctgtttgattttcctcatccccagtctcaaggggaagccaggacaatgagaacagccacttcccatcaggagtcactgcaaggcccccagggtgggatggtggggagataagaaccgtgagagaagttggcacaaaggagttatgggacaaagggtccaagataggcagaaaagaaaatgttgccagttgatggggaagaaaggaagtcggagggctcagacactgagggggacagaacatctccatgtgcagtctcatctcttatagtcagcaacaggtatccacggggagggccctacatcatctgctaccctgaaggatctggaggtaggaggctctgggcggaggtgcagtgaccccgcaggccagccctccaacctcctcccgcagcggggactgggtgcccctctgccagctgagacagcccacacacaacccagccctaatgatcgttctctctacctctcccccaagtcctcctccgcctcctcctctctgcatgcgcgtcagagcccgtgccaagaacaagcagcagtcctgaactcgaggtccataaaaatcagtcgactgaatgacaccatcaaatctttgaaacaacagaagaaacaagtggaacatcagctggaagaagaaaagaaagcaaacaatgagaaacagaaagctgaaagggagctagagggtcaaatccagagattgaacacagagaaaaagaaactaaatacggacctgtatcacatgaaacattctctcagatactttgaagaagagtccaaggatctggccggccgcctgcaacgttcatcgcagcgtataggagagttagagtggtctctctgtgctgtcgccgccacacagaagaagaagccggatgggttctcgagccgcagtaaagcacttctcaagcggcagttagagcagtccatacgggagcagatactgctgaaaggacacgtgacacagttgaaggagtcgcttaaagaagtccagctggagagagatcaatatgctgaacaaataaaaggagagagggcccagtggcagcagaggatgaggaaaatgtcgcaggaggtttgcacattgaaggaggagaagaagcatgatacgcatcgggtagaggagctggagaggagcttgtccagactcaaaaaccagatggctgagccactgcccccggatgccccagcagtgtcctctgaggtggagctgcaagacctgaggaaggagctggagagagtggcaggagagctccaggctcaggtggaaaacaatcagtgcatcagtctcctgaaccgtgggcaaaaggagaggcttcgcgagcaggaggagaggcttcaggagcagcaggagaggcttcgggaacgggagaagaggcttcagcagctggccgagccacagagcgacttggaggagctgaagcacgagaacaagagcgcactgcagttggagcagcaagtaaaggagctgcaggagaagctgggccaggtgatggagacgctcacctcggccgagaaggagccagaggcagcagtcccagcctcagggactgggggcgagtctagcggccttatggacctcctggaggagaaggcggacctgagggagcatgtggagaaactggaacttggattcatccagtaccggagagagagatgccatcagaaagtacatcgccttctaacagagccaggggacagtgccaaagatgcgtcaccgggaggaggccatcatcaggctggcccaggacaaggaggagaggaaggtgaagctgctggagctgcaggagatggtgttgcggcttgtggcagctacagcgaggggcacggcaaattcctggccgctgcccggaaccctgctgctgaacccagtccaggagccccagccccccaggagctcggggctgccgacaagcatggtgatctttgtgaggcgagcctcaccaacagcgtggagcctgcacaaggagaagccagggagggttcttcccaggacaaccctactgcacagccagtcgtgcagctccttggtgagatgcaggaccaccaggagcacccaggcttgggcagcaactgctgtgtgccatgcttttgctgggcttggctgccgagaagaaggagataaacaccaccatcatcaaagagctgctcaagaaatttttaaaaacgaaacaaagttatggggttaatctcctacacaattcatttacttcatttgaatgttagagctactcatgattatttgtgtttctaatttatagtttaagtttatttgtaaaaagttaaaagagagtgggtctctgtggctctcactgatgttcactctggcatccttcagcatttttcttttttcatttcataattgtaggtcattagcatgcatatcgagtttgcccttacgtggtgggagttcaaacacacaaagacccactctttgcacaaaactgttctcgctggtttggaataggctcccgtgcttttctaatgttattgcagcatggatgtccattacagaattcagataaaatttgctaatgttctgctatgatgtttgatctcatcttaatcacagtgagctcttctatagctcaatatgcggtttgccctcaagtgtgcactgtttattactttgtaatatgccactgtgagtactgacatttagagctgtttaaaggccgagaactggaaacagcctttcctccattttctgtgtattggtgatgggagtgataaccttttgggggagctttctaaatctcacagaagaggaaagtggcctgctctggcaggtatgtgcaggatacagtgtgtttcatctgttccggtgccaagaatgagcagtgtactgtggcagttccctttggatttgtatgtgctctgggctcatgaagatattgcatcgtgagctgcagcagttgcactctttttcagtgacctaaaaagggcttatttccgaggaatgaaaggctgccatcattggctgtgggtgtgaaaaacctttcctagcttagagcatttgtatctacaatacattttaaagtcagagttcgtgttccctgttttaatcacatgactacctgtcccagtacacgaaagggcgctggttggcattcttcttaatgtatttagtgaagatcataagaaatcctttaagagtttaaatgtctctgaaacaggcatacaggctctagtcaagaatgaattagagtgaaggaaagctgtgtgacacctggcattcctctctgttcatggagcttctttgaggcttgaagtttgattttactatctagacctctctggctaatacctattcttcaaccacctcggttactctgacataggaatttacttcttttccttgagtggaaaacactttagaaagtaataacaaacattattataaactaatatatgtgagagtacttagttgaaacaaaaaggaattttagtagacagtattatattatctttgaaaatcaaggagaagtttatgcaacttaaaatgtttacacactgtggtgcaatctactgtttgtgaatgtctgtattatcaggaaacatgtctatacgatcgcagagttgtatttcctcacaaacttctttacgaagagtgaaatacgtttttgtacctctcattttcagtcagggacatactttgtgcaatatttctgtgattgtgcctatgcatgatgaatgaatgcatttcaatcatacattgcctaaatcataacttgatgatgcttgggaaagaatcaacagttaaaacttcatgaagttctaatgtctgtgttccaaaacacatcacattattaggttgtagggagatatgtaggtgtgctccctggggtggggagttttctagttactagaccatctccatttttagcacttggcagcctcatgatccttttataaatgtgagattaacaggagagcagcaatacgattttgccaatggaataacagatttgccggcattcactgaaagagggcagatattgggtccttgtaacttcaactgactcttccaaattgtatgaatttatcaatgtattacacaaatccagtttcagaatgataaaaaatgttagaccaaataatgcggctaattaacagtcgtatgatttctagcccatgggtttaaaactgtatcttaaagagtcattttaaaataatataaatattaaaaaatgtaactgctatcttaatgttctgaaataaaacattttaaaatataaatcctgtagtttaaaaggaagaaatggtgggaaggaaaagtagagaaagaaatgccaattccaggccaaagcgttatttgccaagttttcttagaatgaattttaccaatgtatgagttcttgttaacagaatgtgtaacggaaatactgaaagacttttgcttaaagtggcattattgactgctgatgtgatgctactgtaatgcaataaatttttaaattgttgcaaa

SEQ ID NO: 5686 - DNA, 2144 bp, Homo sapiens
cggagttgcaagcaaacgggtttcatcactttaaatggttttgaaccaaagaagctgtattcccttaaaaagacggacaacccatcgtgtgaactatagagtttgtgaacaaatttatattgggttcatagtggcgtcatgcacgcagactcctgcgagttcccctaagttcttagaggactgctttgccttttgatctgagagttgcaaagttccctaaagaatggcccttgtggataagcgctaagtcaagagacagcgattggacagaatttgtgaggaattcgcccccagatcatgaaagtcaccctgaaccccgcctcgtggtggctctgctggatggacgggactgcactgtggacatgcccatcctgaaggacctgaccacctggccttctgtgaggctcagtccatgcaggagatccacgagaaagttctaaacgaagtcgtgggcgccatgatgtaccacaacttctccctcaccagggaggacctggaaaatttcaaggccctgagagtgatcatgcaggtgggcagtggctacgacaacgtggccatcaaggctgctggcgagctcgaaattgctctgtgcagcatcccgtccgcagccgtggaagagacagccgactccaccaccggccacatcctcaatctgtactgggggaacaggtcactgtaccaggcactgagggaaggcacacgagttcacagcgtggagcagattggcgaggtggcctcagtaaaggcccgcattcgtggggagatattgggcctcatcggcttcggtcgcacgcagcaggaggttgcagttagagccaaggcctttgcaggatgggatcgagcggtccctgggtgtgcatagggtctacacccagcaggatttgctgtatcagaacgactgcgtcttcttgcattgcaatctcaacgaacaaaactaccaccttatccatgactttaccataaagcagatgaggcagggagcattccttgtgaacgcagcctgtggtggcctggtggacgagaaagcctgagcacacaccctcaaggagggcagaatacgaggggcagccctcgacgtgaatgagtcggagccctttagttttgctcggggtctgttgaaagatgcctggaatctcatctgcactcctctcactgcctgctacagccagcaggtgtcactggagatgagcgaggcagttgccactgagatccgccaagccatcataagtcgcatcccgggaagcttaagaaactgtgtgaacaaggaattctttgtcacatcagcgctttggtccgtaatagaccagcaagaaattcatcctgagctcagtggtgctacctacagatatctgccaggcatggtgggcgtggctccaggaggacttctgcggccagggaagacatcatccctggagacatcccagtgactgacaacctcccaacagtggtacatccttcccaagggccctctcccaacagcccacaaaacacggggacagtcgagagcatcccaacgagcaatagcagagaatgccggaaggtaattattcagatatacttgggaacagtgaaaaatagataatctaagagaaaaagaatctgacggcctttttagctgattccggacatatgcatcattgttgttgcagtgttaaaacaagagctagaaaactgacaatgtcgtctgcttacggaagctctgaaagactagggtgtgatttactaacgaccaacttctattattgtgtgttaagtttttcatctgtgcatcaaatcacaaagaataaatagaacttttccctttatcagtctcttaggcacagcaggtcctgaacaccctgcttatatgttgcatcagcagttcaaatatcaaaataaaaaccatgaagaggaaatccgcatcctgtgacttgagtcccttcagtctacagggactggttactgctttttgctaataggaagattacattactagaaaatgtggagtaaactgtttgcctgtggtaaacacctgcatgcaaaggattgaagacagtacgggctcctgtacagagacgcgtctctcacatctgagctgcatattgagcggcaagttggttgtaagttcagtaaaagccgctgatgatgcaaaaaaaaaaaaaaaa

SEQ ID NO: 5687 - DNA, 4294 bp, Homo sapiens
ctacgctcttccagctgtcggacctgggaaattctcctgtgctaaatcccgtggcgctcgcgggtgtcgccgcggtgcatcctgggagttgtagttttttctactcagagggagaatagctccagacgggagcaggacgctgagagaactacatgcaggaggcggggtccagggcgagggatctacgcagcttgcggtggcgaaggcggctttagtggcagcatgaagcgcaccccgactgccgaggaacgagagcgcgaagctaagaaactgaggcttcttgaagagcttgaagacacttggctcccttatctgacccccaaagatgatgaattctatcagcagtggcagctgaaatatcctaaactaattctccgagaagccagcagtgtatctgaggagctccataaagaggttcaagaagcctttctcacactgcacaagcatggctgcttatttcgggacctggttaggatccaaggcaaagatctgctcactccggtatctcgcatcctcattggtaatccaggctgcacctacaagtacctgaacaccaggctctttacggtcccctggccagtgaaagggtctaatataaaacacaccgaggctgaaatagccgctgcttgtgagaccttcctcaagctcaatgactacctgcagatagaaaccatccaggctttggaagaacttgctgccaaagagaaggctaatgaggatgctgtgccattgtgtatgtctgcagatttccccagggttgggatgggttcatcctacaacggacaagatgaagtggacattaagagcagagcagcatacaacgtaactttgctgaatttcatggatcctcagaaaatgccatacctgaaagaggaaccttattttggcatggggaaaatggcagtgagctggcatcatgatgaaaatctggtggacaggtcagcggtggcagtgtacagttatagctgtgaaggccctgaagaggaaagtgaggatgactctcatctcgaaggcagggatcctgatatttggcatgttggttttaagatctcatgggacatagagacacctggtttggcgataccccttcaccaaggagactgctatttcatgcttgatgatctcaatgccacccaccaacactgtgttttggccggttcacaacctcggtttagttccacccaccgagtggcagagtgctcaacaggaaccttggattatattttacaacgctgtcagttggctctgcagaatgtctgtgacgatgtggacaatgatgatgtctctttgaaatcctttgagcctgcagttttgaaacaaggagaagaaattcataatgaggtcgagtttgagtggctgaggcagttttggtttcaaggcaatcgatacagaaagtgcactgactggtggtgtcaacccatggctcaactggaagcactgtggaagaagatggagggtgtgacaaatgctgtgcttcatgaagttaaaagagaggggctccccgtggaacaaaggaatgaaatcttgactgccatccttgcctcgctcactgcacgccagaacctgaggagagaatggcatgccaggtgccagtcacgaattgcccgaacattacctgctgatcagaagccagaatgtcggccatactgggaaaaggatgatgcttcgatgcctctgccgtttgacctcacagacatcgtttcagaactcagaggtcagcttctggaagcaaaaccctagaaggagcacaagtctcaggcggaggagaaaaagagatcggcttttctcctccaacgttgtcatgggcttaagcaagagcagtggagacttctcttggcccctagattgtagcacccgggtcccaatccaaaacagctaggaaatggtgcccatgaagttttaaatgttttaaaatgaccctgtgttatagtctgatttggtgttaaacaggaccttcttcccccaaaattgttcagattataaaatgtgagccattcagcccccaaggtccagggcaggcgacaggaacgagcccagcgtgtgacaaagcctaacctactttcctctttcccaagctttttcagagactctggagtggacccagccctctggggaaagacagaacttagagacatcccagttactcaccacacccatagtgctgtccaatatggtagccactagctagctgtggctacttcaatttaaattcagttttaattttaattaaaaatgcagctcttcagtcgccctggccacatttcaagtgcttaacagcctcatgtggctagtgactgctgtattggacggtacagatatggaacattttcatcatcgaagaaagtcctattggacaacacttctataaaaagtttgagagcaggaattctcatttccattcgtctgtagcttctatccccaaaggcaaagaaactaaaagagaaatgactcattgaagattggcctctttcctttctctaagacaaacctaagtaaaagcctgagctttgagtcctatgctcagcacacgggaaggagatgttaataattaaaataaagttgatatcctgtctttagggagttcccttgatctcttgaaagagacacagccccatttacattatttcgtggatttcaccagcatagtatagtttttttctgtaagtccctcattcttatgtaataacaggtggaactgaggtttgaagaacctcagtggcccatcctgatgacattggagactcaaagagacaagagagagtagggtttaaaacctgagctttaagactcccactagcttcgtgtcctttggcatgttaacgtgcctcagtttcctcatctgtataatggggatatatgaaaggcaccagtcctaaggtgaacattaagtgagatgattctagttacagacttagaacaatttccagcacatagttaaatatccaggaaattctggtactgttatgtgtgggtgagctgacctggatgtagatgttttcctctctcttgctgacccctccgccagttttgtcttgtgatgccattaacacatctctccctttctgacctggctcctgcccattggtgtcccaagaaatcgtgagaatagttagccccccgtctccccagcctgttgctttctcgtgtagttgttcacagtagttgagaagttgaagagcttttgcctattgaaggtgcactgagaataaactctttcctgccaccagaattgcagtggttcacggcctgcactcattcccatgaatgcagttaatagccacagaaatgtcacattaagcaaagcagccagggtctcatcgtgttgagactcgagtctctcagaccttggattcattccctggtgtctttgagcctcagtttcctcattggtaaaagagaagtgaagcagtgtctcacagggtcattacagagattaaatgaaataaatgaaataacatagaccaggagggcgtggtgtttaaaagtcacagatggggcaccctcgggccatccagcccagtgttttctttagcccctatgatgttcattttttgttatatcccattaggtgcccatatttaaaaattgggagatttcacataaaattaaaaggtctgcattttcttttttcttttctttttttttttttttgagacacagtctcactctgtcaccaggctagagtgcagtggcacgatctcagctcactgcaacctctgcctcccaggttcaagtaattctcctgcctcagcctcccaagtagctgggactacaggcacgtgccaccacgcccagctaatttttgtatttttagcagagatggggtttcaccacattggccaggatggtctcgatctcaacctcgtgatccacccacctcggtctcccaaagcgctgggattacaggcgtgagccaccgcgccaagccaaggtctgcatttttctttagaactcagaacacccaatagtcctaggcccccatcctcgcatggcagcaagctaaataagcatcttcccactgcgagttggggcatgacccagcctatggtttgccatactccctctttttctccgttttttcattaattgtgaacctgacctgcatcaccctttcatgtcagtgctctccaaacctgcttgcttgcacccctctagtcgaaatattttgtgcttaccccaatatatgtgtgtgactattgaactctattcgtagactgcttgtactaatgtcatttgcatcataaaatattcatatccaataaacatattaaaaggatgagataagaaaccgaga

SEQ ID NO: 5688 - DNA, 8313 bp, Homo sapiens
agagaactcatgagttttccgcttcatcatctgcttctgttttctccatcttagtttgcccaaagcttgctggccgctgtgtagggctggtgagtggctggggctgtctgagccatgaacaacttcagggccaccatcctcttctgggcagcggcagcatgggctaaatcaggcaagccttcgggagagatggacgaagttggagttcaaaaatgcaagaatgccttgaaactacctgtcctggaagtcctacctggagggggctgggacaatctgcggaatgtggacatgggacgagttatggaattgacttactccaactgcaggacaacagaggatggacagtatatcatccctgatgaaatcttcaccattccccagaaacagagcaacctggagatgaactcagaaatcctggaatcctgggcaaattaccagagtagcacctcctactccatcaacacagaactctctcttttttccaaagtcaatggcaagttttccactgagttccagaggatgaagaccctccaagtgaaggaccaagctataactacccgagttcaggtaagaaacctcgtctacacagtcaaaatcaacccaactttagagctaagctcaggttttaggaaggaactccttgacatctctgaccgtctagagaacaaccagacgaggatggccacctacctggcagaactcctggtgctcaactatggcacccacgtcaccaccagtgtcgacgctggggctgctcttattcaggaggaccacctcagggcctccttcctccaagacagccagagcagtcgtagtgccgtgaccgcctctgctggacttgcctttcaaaacaccgtgaacttcaaatttgaggaaaactatacctcgcagaatgtcctcaccaagagctacctctcaaaccgaaccaactccagggtgcagagcattggaggggttcctttttacccaggcatcaccctccaggcctggcagcagggtatcaccaaccacctggtggccatcgaccgctctggcctgccgctgcatttcttcatcaaccccaacatgctacctgacttgccaggccccctggtgaagaaggtgtcaaagacagtggaaactgctgtgaagcgctattatacattcaacacctaccctggctgcacagatctcaattctcccaacttcaattttcaggccaacacggatgatggctcctgcgaggggaaaatgaccaacttctctttcggtggggtttatcaggaatgcactcagctctcagggaatagggatgtcctcctctgccaaaagttggagcagaagaatccactcactggtgatttctcctgcccctctggctactccccggtgcacctgttatcccagatccacgaggagggttacaaccacctggagtgtcatcgaaagtgcactctcctcgtcttctgcaagaccgtgtgtgaagatgtgttccaggtggcaaaagctgaatttagggctttttggtgtgtggccagcagccaagtacctgaaaactcaggactgctttttgggggcctcttcagcagcaagagcataaaccccatgacaaatgcacagtcatgcccagccggctactttccactgagactctttgaaaacctcaaggtatgtgtttctcaggactatgagttgggaagcaggtttgcggtcccctttggcgggttctttagctgcacagttgggaaccccctggtagatcctgctatatccagagatttaggggcaccgtctctgaaaaagtgccccgggggcttcagccagcacccagccctcatcagcgatggatgccaagtgtcctattgcgtcaaatccgggctcttcacaggagggtccctgccccctgccaggctcccacctttcacccggccacccctcatgagtcaggctgccaccaatactgtcatagtgaccaattctgagaatgcgagatcctggattaaagactcccagacccaccagtggaggctgggagaaccgatagagctgcggagggccatgaatgtcatccatggggatggtggtggtctgtcaggaggggctgcagctggggtcacagtgggggtcaccaccattctggctgttgttatcaccttggccatctacggcacccggaagttcaagaagaaagcatatcaggcaattgaggaaaggcagagtttggttccaggcactgcagcaactggagacaccacttaccaagagcaggggcagagtccagcttaaatctctccccgaaaatggtttctctcatctccagtgtggtcattgctgaccactctgttttcctaagcattgaaatggcaagtgcaaccaaaagtaggtatattcgtgacttcttgtttaggtctctgggccaggaaattcatactgttacatggataaggttgggattggggagagggaacagttgggactagaagcaaaagtgattctgggactaaaataggaagcagatgtcctttcccaatgtgtgttgctgtcttcacctgaatgcatttgtgtaaaaatagcggagggacaatgtgaacatttgtatttggaagctatgaatttactctgaagtttgcagttgtttccaatttgtgagctctaagagtttctgcctgtaagaactactctccttttattttgatttttaaaaacctgtctgaatttcacactcttagagcctggaagagccctgaaaagacacaagtcttgcctggctactgctttttaactttgagggctctatgttgacagactgttatctcctctgggtgacctcaaacatctgaaaagaaagatgttgcctgtgccaattccactttttccagctgccccttgatgaacactcccttataccagaccactcttggacttctgactggtgtcatcaagtcctcagaaaatattttaagttattttaagttattaaggaagggatgatttggagacaaggagtaatgaaagatgggtaaaaactggaaaagattctggtgctaagtactaccccttcatcttccatggatggtcattacctttcctgtcctcctgttatatgaacacacacacacacacacacacacacacacacacacacgcacacacataccacatttcaataagtcttcattgttctgggtccttacctttcctgtcctcctgttatatgaacacacacacacacacacacacacacacacacgcacaccacatttcaatgtctgcatggttctgggggtaacaaaggcaagaagttaaagtaagaccacatttgagtattacttactctgtagaatcaaaacagagtagttaacaccaattatgcaaactacttttttttccagcagaaagggagctgacatgatcaaatccatgttttcaaatgaactgaaaaaggcatccagcaccacttataacacatttatttcagttccaggctgacagccctggggcatctagcaggatgcataattgtcatctggtgagagttgggactttgctcaattttaataccaatctctcctgattgtaattacctccactactttcatgatccccctacaatatttttttaaatgatatatttattcactgaatcaaatgtcattaatgagttatcttctgtggaggatgactgttctctttgttaatgttcacaatcaagatcttgggctgagaagaggcccttcacccaaggagtttgaagtatcacagtgtgtgggaaggtgggaaccaggatacccattcatttccaaccgagacacagagaagtgagtcacagaatttgagcccgctctcttgactgcccagccagagacactgatttctgtaacctcttcacttgatcctgcctcttaagcattaaaacattctcctaaacctctgagtgttttgtgggttctgggtgttttgtacattttagccaagctaaccacttgtctgcaagtactgactttcctatgaattctttgaagattattgagtcagaaaggaaaaatatagccccaaattcccaggcttttaatgcattacattaactgcctattgaaatgagaagttcttcacaaacttgtatacccactaacaagattgcacataaacatgcattaaagtatatactaagaaaccctctgtccaacggctcatgcatatgaagtccgaacatgggagtttgccaattgcattcatcaagtcgttttgcggagtcagatccctgatggaagagctcacaggctctgccttccaagtcctgggttcctaactggtgaccttagcctggggtctgtggggagaccaaccctggcttccaagaaaaccacattccatggactatcagaaatagacacagatttgggtgacaaagctggctctgtatttgcattttatttttgtgttcttgtcagtttgggaatgattaatattaaacatttatttgagaaacaacagcctgtaaataatttaaacacacactatattgcagccaggcaaagagacctttaaaagtgaatattcgtgattctaaaagtgtttttctcccacacgttcacttactcattttcccagcaatgtggtctgttcctttaggcaaacaaagtctagccaggtcaaatgtgtgggtgggtaatatgtggaaaatttgtttttaagtggttggggagggacttcccccacccagtggcagggcttgtggttgcttacagactcagggaggtaacccaaatccctcacagataggtgcactaatctacaaacagcagaaggccaacaagagtaacaattttgtggttgttcatttgccatttattgttctgcaaagacacctcatgagcaccaggtggcgatgtcctttcacggagcaacaccaaagacttcaaaaacattccagttacaaacagaacaattcacttaggacattcacctgcctctcccagaacccccaatctaatgccggggaccacagagaaggaaaggggtcaggggtcctttcttgtaccagtgagccttcccccagttttctcatgcacacaacagtgcaataccaagacgagtacttttgaccaagtataaaaccacagagaagaccaaaatgtacaaaaatgggaagagaatgaaaacacaaaggcacacgcagccacaaatacacaattaaccttttaggggatgagcatctgacgaggtttgtctccaatccaatttgtcatccctggagactctggaagggagaaactaggctgctggtgctaagaccatgaaagggaaggcatggaatcccctacttgggccaggagagcagagcagagcttctagtgggaaaacactctgtgtcaaggtagtagatgcacagggctcagctggcagggttctcactgaaatctagactgcacctttccaggttggcacaagacaaagggcagaggaatgctccccgccttgccgggcacagtgttagaaaggaaattcaagatccctactgcccagaaagccacacaagaacagcacgaggatgaggtagcccctactgggcatctgcagagaggacaagaaagggggcacagacacaatcaaaagcccaggggaaaaggcttgaaggtatgaagtcgacctctccaagtggtattgccacaggcacagcggctccctttccatcttgagtcttcttccttctgctcctggccacccccttccccacctataccttcttctccctgatgtggggaaactgatctctccccagtgcctaattccattttgaaagtctgtcttcttttcttccccacctcctactgcctcattgtgtctttcttcccatggaccctcagcctatttctgcatccttgcggccaagaagctcagcagatacttgaccagtgtgcgaaggtagagacggcatgaggctctccaagtaatctctgtacatggtaacctgacaaagggcatgggtgtgatattaaacaccgcagggatgtctcttccatttagttcaggtgtttccttcctaactatggcaggaaattgccctgtggtgcagtaaccttgggaccagtctcctggtctgctggtgagatacaatggctgcctgccgacaggagacacagggacaaggatggcagagcaattcctcccatcagagctccctctggtggagctgatcaacatccctgtaaccatttggaaagagagcaaaggctcagcaccagcacatccacagaactgggtgacaggcaggtgaatcgactgacaggcaggtgaatcgactatccaccccaatgtcaaaatggctggaggcctaacagcaagcagctatggggctggctttatgaaagattggcctccagttcccatctaagtaccatttttgaaggttctcttgtttccatttttctagcatcaaaaaccttccaaatattatgaaatatatatgcatatatatatatatatatatacgtcaaacccccaaaacatgaggtatataaattcaaattagtatccagaggaacttcccccaaacacatagttcaaagaacccactttcaaagggggaattgggtttcccttcttgatcccccctgttctcctccctggcccccaattcgttccttactgggagccaaaggcaataagaatgttggggaggagatagggtcttgggacacaacaagatgcagattggaccagaccatattgtgatcccaactccattaggaatgagctaaagagattctctccctgctgtaagtcaatctataatagatgagggagatgagggacccagcagctctgggctctgattagcaaatttgcatggaaacagattgaagccttcatagaaacaagactggatggagatgagctctgatccaatcttgaaaagaaatataaaaggatgagttcagccctcacctcattgcatctccccaggcacagttctgtcttcattggggtttcagttcactacgggataggttggcaacaggtgaggaacgtcaaaggaccacagcctggctgttggagccccatcagaactggggtttggcatcttgcaaaacagagtgcagggacatgacgggccttcccttcaagctggcccagcaatgcacacacgcccacacacacacgcgcatgcacagacacagagggcacagagcccagcatgggctccactcacagtgactcgatgaaactcatggaatctttgagctggtctagaatgagttgggaagaaggctgtgggctcctctccctgaggacagttcagatgctcagtgggatgcaggctctggtttgatcagagagggtctagaaacagcatcatgggatgccactccaaagaggaaccccagagtccatccatccacatgagagaaccagatgcctctttggacaggtgagagctgtgaggaggagaggagggcccagagaagccaaggactgtgatgacagcagaatgtgctcccagaggcttttccttctccgaccctcttgggaagaagtgcttccttgctctacaccaaggcatcagtttctgatgtcacagcagtttagtgattcacccctttgcccaccccccaaccttgcacagtgagagctccctgcctccagcagagggagaatagcagaaactccagtctcaaagcagagtggaagtagcaagaagccggctgaggcaagaaaccccggcttcccaaagccaggatatggagtgcctaagcactgcccataccctaggtgtgctgaccatgcccctacttgggaggtggggtagggaggggattcctgcctacccagcaccaaaaactccatgggaacagacccaggatggccctcatcccatctccctttgtgttggatgagatttatgaatgatgtcgctatattcagtctggctcccactgtggttgggagggatgagggatggacacagggcaggaggggaggatagaaagttgggagggcaggacaccaacttcttctacattgactcactctcctcacttcctgtcctgcagtctccatggcccctcccacctcaaagcttttctggcctcagtccttctcctgggcagtgctgtcctcagagatgccctgggcagccagttcagccagcacattatccaggtaattggcatctgggtagccatggccagtgagattagagccaaactctgtcttgtggtggacctcattccagatgacggtgtctgactcgcctgtggtgctggaggtgccaatggcaaaaatgaggcggcgatcccaggccacgagcagcagcttcagaacctagaggga

SEQ ID NO: 5689 - DNA, 1110 bp, Homo sapiens
gcgtgtgaacccccacagccctacacaacttggggcccctctcctccccagcccttctcctgtgtgcctgcctcctgccgccgccaccatgaccaccaccatccaccagttcacctcctccagctccatcaagggctcctccggcctgggagtggctcatcccgcacctcctgccggctgtctggcggcctgggtgccggctcctgcaggctgggatctgctggtggcctgggcagtgccctccggggtagcagctattccagctgctactgctttggctctggcggtggctatggcagcagctttgggggcgttgatgggctgctggccggaggtgagaaggccaccatgcagaacctcaatgaccgcctggcctcctacctggacaagatgcgcgccctggaggaggccaacactgagctggaggtgaagatccgtgactggtaccagaggcaggccccggggcccgcccgtgactacagccagtactacaggacaatcgaggagctgcagaacaagatcctcacagccaccttgaacaatgccaacatcctgctacagattgacaatgcccatctggctgctgctgacttctgcaccaagtttgagacagagcaggccctgcgcctgagtgtggaggccgccatcaatggcctgcgcagggtgctggatgggctgaccttggccagagccgacctggagatgcagattgagaacctcaaggaggagctggcctacctgaagaagaaccacgaggaggagataaacgccctgcgaggccaggtgggcggtgagatcaatgtggagatggacgctgccccaggcatggacctgagccgcatcctgaacgagatgcatgagtagtacgagaagatggcagagaagaaccgcaaggatgccaaggattggttcttcagcaagacagaggaactgaaacgcgaggtggctaccaacagcgaactggtccagagcggcaagagcaagatttcggagctctggcgcaccatgcaggccttggagatcgagctgcagtcccagctcagcatgaaagcatccctggagggcaacctggcggagacagagagccgctactgcatgcagctgtcccag

SEQ ID NO: 5690 - DNA, 1518 bp, Homo sapiens
cagcaatattgaaattaggccaattaataactctataaaggcctctgtgttcaagtgaaagtaagagtcacacatctcttattataaatctaaagtgagaaatgattaagctgagtgaggaaggtatgttaaaagccgagacaggccaaaaggcccaggctggtctcgaacgcctgacctcaagcaatccacctgccgcagcctcccaggtagctgagattaaaggcatgagccaccatgtccagcttctatgcattattttaaatggagtattgaagactctattactgtagaactatttctaacttcaattctgtcaatatttgggtcacaggccttaatgttattacacgctagtctgatgctcatggccaggacattttgttttcctgttggacataaacaatctcacagaatatcaacttcagaaggttaatctgagaccgtgataagtgcaaacaaaaacaagggcactttataatgttgtctaagtgcagataaaaaacaaggtcttgatgccacccagaaaatacttaataatcatattgctcctgctttctgacagcatccaatctaaagtcttcactttctgagatcctgtccgaaatcaaccaattaaagcccaaatcgtataacagtttctctctaactcctcccactgagatgacccatagtaccccattccttgctgcaatgtaattacaagtgtgctcctggtggtctttaactgaagggcactgactgggtactggtgaagttccccgcaggaactgagtcagaccccatctcagggccctgcagaagataggtgcctgctctaaggcgtggaccctcgcgacagccctggcccgtcttgacgggcgagggttactgtacttgtcccaaccgtacagatgagaaagctcagactcagggccagcaaccccggtcccagcggagcgcccggcacgcgccgacacttcagcaccagtcgcggtggccaccactgtgcgcggagatggctgcgacgcgtgcgcagatctcgatcccaaactccctcctgccagaatctggacccgaatccacccattgcccattttccgctgccgctggagagaatctctgaggtccccaggacagcctgcctgcacggaagagatgcctcctcaggaaatttgtgcacagagataacacaggggatatgccatatgaagatgaaggcagaattctacaagcccaggaatgccaaagattgccagcaaaccaccagaagctaggagagaagtgtggattagattctttctcacagccctcagaaggaaccagccctgccaagaacttgatctcagacttctagtctccagaactgtgagacagtgcattttgttctgtaagtcagccacatggtttgtggcactttgttatggcagccctaggagatgaagacaatatgcaacatggtatgtccattataggacactgtgggctataaatgtgttctttggcctgaagaaataaaacttggtggtccaagttgat

SEQ ID NO: 5691 - DNA, 2503 bp, Homo sapiens
aataaatatggagggcagtgtaaagctcagggcccttgtccactagagacaaggtgccctccgaccccttcttccaaatatactcttttgcctcttgtcttttattcccgtgtttgccccctttgttcagtccccctaggtccatgcaggttacatagtggtgccccaaacagtgacacaattgggttctcaacaagtggtgactcagaacagggacgccaaggatgccaacaagtggcgtctgaacacgggacttcgacgatgtgaacaaaaaagatctgctggagcagagaagctgaaattgacaaggcaaacggggaccccaggatgagtctgccggcagcatatataaggcagggactataggaaatgaaggtgaactcgtggagattttggagagaatttaatgaagaggctgtttaccaaggatctctctctgtctccgaggctggagtgcaatgttgcaatcagggctcactgcagcctcgacctcctgggctcaactgatcttcgtaccacagcctcatgagtaactgggactacagatagtatctcatgatatgaatggtcctggatttacttacacatcctcctttggatgagcaaaaagtaaatttttcacagtgatagacatttgtagtgctttttaaaggcactggttctggtggacactgagagacaatttttatttgctgcacgtggaaaggacaacaacatacctggacagaaatgcctcgaggatgtactgaaggcccctctcacttttcacagccataactgtaagtttcctggggcctctccagaagacaagcagatgccgctatgcttcctgaacagcccacagaactatgaaaaagttaaggctagacgggtcaagccacttgactgataccacaggtcagagcatacaaaggactcaagatcagactagtaatcaaggaggcgtgttgagccaagtgtacaaattcaacagctgggaaggtattatggggaggtcttgtaacattttattcaggtttccttgaaaagaactgaaaactgatgaaacttttagaccgaatattcctttgaaaacatgaatagaattcatttgctgagaggcatgtattgaaacgtgatatctagtgcatggttatttttcactttctaaattaaactgacatagagagtttgagaaataagtttaagaaatagacatggcttatgattgaaagcacaattttccatctaaatgttggtccgtgttcatctttatctcagttagtagcaacctttgttccgcagcagttgttcgttgattgttatggtctgtcgacagctccagctcgtgccatcttcccaatgtaccaacttctctttctctggtcaggttgcgctgttgcctttgtatgtcttcccacctcatggatgttagtttcattatgagaatattgaaaaacagtcttccagtcataaccccactggcttccttttctctgtcacttccaaaccgcaggaccattgctgggcaccatgtctacccacccatgagagttaggaataaacacaaacgagttcaattcagttcagcaaacagttattgtgcatctattttatgccaggaactgcagaaggtgctggggtacaaagtgaagaagataatttgcttggtctcaagggggagctcctggtctaatacccaggctcctataatccctcagcattatcctctccactttgcctgttcccctgttgctcattacctgtgcaaccgctcctccctctctggctcaattcctgcttttcttccctctgttcctttatcctgctagtgtcttccttttcaaccatagccaacactccatcttcaaatgcttagcgatacaacttatacctcaactatctggaaaggctttctgaactaagtaggagaagttgtaaatatttaactttttatttttctaaattatctgattataagcaacagtaaaacaaagatcccatattattatctgcagagttaatttggggacaacagggacctcttagtttttttgattaattttaaacttacttgtaattaattggtagtatatgttacaaaccattaaaaattacttaacagtaatcacttttgaaaataggaggaaaataaacatttttatggcagatttgtttgccttaagaattattttgaaagaagtattagaatcgaggcttagaaaaacggtagagtgcttggctgggcgcagtggctcacacctgtaatcccagcactttgggaggccgaggtggatggatcacgaggtcaggagttcgagaccagcctgcccaatatggtgaaaccctgtctctactaaaagtacaaaaattagccgggcgtggtggcgcacgcctgtagtcccagctactcaggaggctgaggaagatcacttgaacccgggaggcagaggttgcagtgagccaagattgtgccactgcactgcaggctgggtgacagagtgagactccatctcaaaaaaac

SEQ ID NO: 5692 - DNA, 7958 bp, Homo sapiens
agagggacggaggaagctgccggtataacgggaggagagcgccaggcggagctggggcgtccctcccgctcgcttcttgactcgcgttggtgccggccgcctcccgcgcctagtgtccgggacgcgcctgaacctgccgcctccgtgcctggggcggcgccgcgcggcccccaggctcccgcggggccgacctcggagacgcagctggggccgggcgcggcttggcgggagggtctgcagcgccgagggaggctgccagtgcgtgaggaagagagctagagactggacaggggagacagagcagcgtcggagccgcgcaggggacgggagtgagagcgggagtgagagcaggaacgacgcagagcggccgtcgccgtgcccgggtctcagggcgcctggctgaagtgagcatggcttcagtggcctgggccgtcctcaaggtgctgctgcttctccccactcagacttggagccccgtaggagcaggaaatccacctgactgtgattccccactggcctctgccttgcctaggtcatccttcagcagctcctcagagctgtccagcagccacggcccggggttttcaaggcttaatcgaagagatggagctggtggctggaccccacttgtgtcaaataaataccaatggctgcaaattgaccttggagagagaatggaggtcactgctgtcgccacccaaggaggatatgggagctctgactgggtgaccagctacctcctgatgttcagtgatggtgggagaaactggaagcagtatcgccgagaagaaagcatctggggttttccaggaaacacaaacgcagacagtgtggtgcactacagactccagcctccctttgaagccaggttcctgcgctttctccctttagcctggaaccccaggggcaggattgggatgcggatcgaagtgtacggatgtgcatataaatctgaggtggtttattttgatggacaaagtgctctgctgtatacacttgataaaaaacctttaaaaccaataagagatgttatttctttgaaatttaaagccatgcagagcaatggaattctacttcacagagaaggacaacatggaaatcacattactctggaattaattaaaggaaagcttgtcttttttcttaattcaggcaatgctaagctgccttctactattgctcctgtgaccctcaccctgggcagcctgctggatgaccagcactggcattccgtcctcatcgagctcctcgacacgcaggtcaacttcaccgtggacaaacacactcatcatttccaagcaaagggagattccagtaacttggatcttaattttgagatcagctttgggggaattctgtcacccggaagatcacgggcattcacacgtaaaagctttcatgggtgtttagaaaatctttattataatggagtggatgttaccgaattagccaagaaacacaaaccacagatcctcatgatgggaaatgtgtccttctcatgtccacagccacagactgtccctgtgacttttctgagctccaggagttatctggctctgccaggcaactctggggaggacaaagtgtctgtcacttttcaatttcgaacgtggaacagagcaggacatttgcttttcggcgaacttcaacgtggttcagggagtttcgtcctctttcttaaggatggcaagctcaaactgagtctcttccaggcgggacagtcaccaaggaatgtcacagcaggtgctggattaaacgatgggcagtggcactctgtatccttctctgccaagtggagccatatgaatgtggtggtggatgatgacacagctgttcagcccctggtggctgtgctcattgattcaggtgacacctattattttggaggctgcctgggcaacagctctggctctggatgtaaaagccccctgggagggtttcagggctgcctaaggctcatcaccattggtgacaaagcggtggatcccatcttagtacagcagggggcgctggggagtttcagggacctccagatagactcctgcggcatcacagacaggtgcttgcccagctactgtgagcatgggggcgagtgttcccagtcgtgggacaccttctcctgtgactgtctaggcacaggctatacgggcgagacctgccattcctctctctacgagcagtcttgtgaagcccacaagcaccgagggaacccatccgggctttactatattgatgcagatggaagtggccccctgggaccatttcttgtgtactgcaatatgacagcagactccgcgtggacggtggtgcggcacggtggccccgacgcggtgaccctccgaggtgcccccagcgggcacccgctctcggctgtgtccttcgcgtacgcagcgggcgcggggcagctgcgggccgcggtgaacctggcggagcgctgcgagcagcggctggctctgcgctgcgggacagcgcggcgcccggactcacgagatggaaccccactgagctggtgggttggaagaaccaatgaaacacacacttcctggggaggttctctgcctgatgctcaaaagtgtacttgtggattagaggggaactgcattgattctcagtattactgcaactgtgatgctggccagaatgaatggactagtgacacaatagtcctttcccaaaaggagcacctcccagtcactcagattgtgatgacagacacaggccaaccacattccgaagcagattatacactggggccactgctctgccgcggagataagtcattttggaattcagcttccttcaacactgagacttcataccttcatttccctgctttccacggagaactcactgctgacgtgtgcttcttttttaagaccacagtttcctctggggtgtttatggagaacctggggatcacagacttcatcaggattgagctgcgggctcccacagaagtgacattttccttcgatgtggggaatggaccttgtgaggtcacggtgcagtcacccactccctttaatgacaatcagtggcaccacgtgagggcagagagaaatgttaaaggagcgtctcttcaagttgatcagcttcctcagaagatgcagcctgcccctgctgatgggcacgttcgtttacagctcaacagccagctcttcattggtggaacggccaccagacagagaggctttctaggatgcattcggtctctgcagttgaacggggtggccctggatctggaagaaagagccacagtgacgccaggagtggagccagggtgtgcaggacactgcagcacctatggacacttgtgtcgcaatggagggagatgcagagagaaacgcaggggggtcacctgtgactgtgccttctcagcctatgatggaccgttctgctccaatgagatttccgcatattttgcaactggctcctcaatgacataccattttcaagaacattacactttaagtgaaaactccagctctctcgtttcttcattatacagagatgtaacattgaccagagaaatgatcacactgagcttccgaaccacacgatctccgagcttattgctgtatgtgagctctttctatgaggaatacctttcagttatcctcgccaacaatggaagtttgcagattaggtacaagctagatagacatcaaaatcctgatgcatttacctttgattttaaaaatatggctgatgggcaacttcaccaagtgaagattaacagagaagaagccgtggtcatggtagaggttaaccagagcgcaaagaaacaagtcatcttgtcctcagggacagaattcaacgccgtcaaatctctcatattgggaaaggttttagaggctgccggcgcggacccggacacaaggcgggcggcgactagtggcttcactggctgcctctcggcggtgcgcttcggccgcgctgctcccctgaaggcggcgctgcgccccagcggcccctcccgggtcaccgtccgcggccacgtggcccctatggcccgctgcgcggcgggggcggcgtccggctccccggcgcgggaactggctccccgactcgcggggggcgcaggtcgttctggaccagtggatgagggagagcccttggttaatgcagacagaagagactctgctgtcatgggaggtgtgatagcagtggtgatatttattttgctttgcatcactgccatagccatacgcatctatcaacagagaaagttacgcaaagaaaatgagtcaaaagtctcaaaaaaagaagagtgctaggacagctctaaacagtgagctcgatgtgcaaaacgcagtccatgaaaaccagaaagagtgagtcttctgattggcagctgtggctgtctctatcatcgtgactgtggacttccctgctgttgccatcagggtgcacacagcaggtgcagtgctgtcacctggctgaagatctgcagcctcagagcctctgggaggtccctttctccctcggtgaaacacagtcctccacatcaatttccaaacaatgaattagttatggccattcatcactgttcagtagtttccccgtccaaaggctctcttccaaaactgcagtttgatctgtgttaataattgtggggttttagatgagaaaatgactataaagctgtggccctactttattttttaaaaatgacagaacttttgttcagatgtaaaagacaaaattgcactttaatgttttttgttacttgaaaacatatctgggatccctttttttggtcctctgctgatatttataaaacaagaaatgcttcttggactaccttcactggcatttccatagtcctggaatccagagccaagtggcctatctaaaattcacagcccttttattctcctgtgtgatggttaatacaacacagttgaagcctggaaacactaccattatttttggtgtattgctttttctaattgactgtttttaatgattttgatacattttaatgttgaaattaatattgaatgttagctatgaaattttagtattgaattttataatggaacagaacattggtaggtaacaagatgcaagaggatgtcaatacaagattgtctgcctgtttttctttgtaatttgtaattacagtttttgtaacttgtgattatgtttttaactaaatttaccaccagatacaaacactacttcttacacagagttatcctttatttatatcattaagacgtgaatgaaacatcatcctaacttacttccccaagatattgagaggtcatatctgtttttctttatcattcatttctttttctaaaagttgttactgatatgcttttgatttcctatgactctattatgttgtacagaacatcttttcaatttattaaaaaaaatagcttaactgaagatcactaattccttttctaaattttgaactgctctaggcataaatatcattgtgtattatcctttcatctaatcacttttggaatgtaaactgaaggctgttcactccaagttaagttaacatttacatgatgtttattaaatctgccagtctgatcaaaggtttatgaccatggggccaaattcccatagattacccaaaattgaatatgtgcagttaactggaacatgtctcattaaggtttacatacacactaagacagcaaaggattggaattaactttatggagacagttccagggactaatattgaagcagtggttatttgataatgcatggaaccaccatttggattcaataaaccaattacataaaagcaatgatgctacgctcttcatattccagataccaactgcctaccaaggactaatgagatggtatatttcttccacatcagggcaagctgaaaatatattgattcagcgttactgttatgtaaatgaatttccatcttctcatatgtgttatttttgaaagaatgaatacactctctgtcttaaatccgctcttaacaaatgatctcttctcagaatactacatctgtattgagagtacagacagcccattggtcactgcaccttttgcaagacagcgaaacggatgcatcaaattgcattgatacatcatcaccatcaatcttttgcactgatttttagacttaatcttcttatttgaaaataaactcatttttaaataaaataaaaaatattttagggaaagctctataaaattaaaattacagaattatatgctttttaaaatttatgcaaaaatgtgcagacaaatgtattctgtattggtttatgtatcactttgcccttgtatattttgagattattaagatttgttgacttttttggtttgatatttatcatctgttaaatttttccttttaaattattaaatgcaaagtgcaagaaaaagagataaatatttactgattgctagatgtaaaaatatctatgaatatatatatttaaacttctgccagagagcaaccatctgacagtcaacttactaaaatctaaattgagtactttttactgttgcagagaattaagtcactaaacattatttagatatatagatgctagttgcaagtaacacccttttgtaatataaaagtaaaagcataataatttcccaacttttgtcttcaaattaaaaaagaaaatagcatataattaccattcttcatttgagaaagctgaagattctgatgcttaaaaacttcagaattctaatattaaaaatagagtggttcatgtgacattgaaggcttatctctgtaaaatagtgacactggtgagtggtattatctcaatatttttgtccaaattcaccttaggaaatcactgtaaatcttcattgtttcctaaaagtcattattacggcataaacttaacatactttgatagtagttagtactgatacgtgacatattctaccccgtgtctctgttactctgtctctattactgtgaaaagtcacagtaaatttaacattttcttccagactgtgtatgatctttcattgtaatagagacatggagtaggataagtcatgtattaacatataagatttttttaacctgctccctcagttttatagatgagacaaagataaggttgtaagagctaatctcttcaagtaggcagtactagtaagttgtcatgcgtggactgaactcctggcacttctttctcttaacttcaatccatagagaagcccaccttcctgccttcccagtattatttagcagaggagaaaatcatattaggctgtttgatactctgtttgcctagactgaccaataattctggatctttgttcacatcttctctgaaagaatatttgatgggaaatcttttttattttttaatttttgtgtacatactaggtgcatatatttatggagtacatgaaatgttttgatacaggcatgcactgtgaaataagcacatcatggagaatggggtatccatcccctcaacatttatcctttgtgttacaaacaacctgattacactctgtattttaaaatatgcagttaagtttttattgactatagtcaccctattgtgctatcatatagtaagttttactcattctttctactttttttgtacccattaacctatccccacctctgccccaccattatctcagctgtctactacttttttcagcctttactaaccatccttctactctatatccatgagttccgttgttttggtttttagatcccacaaataaatgagaacatggcaatgtttgtctttctatgcctggcctatttcacttaacataatgacctccagttccatccatgctgtcgcaagtgacaggatctcattctcttttatggctgaagagtactccattttgtatgtgaaccacattttcttcattcatctgttgatgaacacttagggtgtttccaaatcttagctgttataaacagtattgcaacaaataaaagagtgcagatggaa

SEQ ID NO: 5693 - DNA, 5156 bp, Homo sapiens
ccgctaatgtaccatgccctggtgctggaaagtgcctgagccagctgccccagcggcctcagcactaccaagttggcacaaagctccccaaattcggaggggctcagggaaacgagtggaggggatgaggaggtgaggggtaaacccatcatttcagttggcatttgagcaggtgccatgctcagcggagatgaggctctcccatctgtaggggccgtattaacatgcacactctaaaagtgcccttcgtttctccagcctcagctttgtccctctcctcctccacgtcaacctggccagagggtctggacgccacagccagggcaccccctgctttggtggtgactgctaatattggccaggccggcggatcatcgtccaggcagtttcggcagagagccttgggcaccagtgactccccggtcctctttatccactgtccaggagctgcggggactgcgcagggactagagtacaggggccgaagagtcaccaccgagcttgtgtgggaggaggtggattccagcccccagccccagggctctgaatcgctgccagctcagccccctgcccagcctgccccacagcctgagccccagcaggccagagagcccagtcctgaggtgagctgctgtggcctgtggcccaggcgaccccagcgctcccagaactgaggctggcagccagccccagcctcagccccaactgcgaggcagagagacaccaatgggaatcccaatggggaagtcgatgctggtgcttctcaccttcttggccttcgcctcgtgctgcattgctgcttaccgccccagtgagaccctgtgcggcggggagctggtggacaccctccagttcgtctgtggggaccgcggcttctacttcagcaggcccgcaagccgtgtgagccgtcgcagccgtggcatcgttgaggagtgctgtttccgcagctgtgacctggccctcctggagacgtactgtgctacccccgccaagtccgagagggacgtgtcgacccctccgaccgtgcttccggacaacttccccagataccccgtgggcaagttcttccaatatgacacctggaagcagtccacccagcgcctgcgcaggggcctgcctgccctcctgcgtgcccgccggggtcacgtgctcgccaaggagctcgaggcgttcagggaggccaaacgtcaccgtcccctgattgctctacccacccaagaccccgcccacgggggcgcccccccagagatggccagcaatcggaagtgagcaaaactgccgcaagtctgcagcccggcgccaccatcctgcagcctcctcctgaccacggacgtttccatcaggttccatcccgaaaatctctcggttccacgtccccctggggcttctcctgacccagtccccgtgccccgcctccccgaaacaggctactctcctcggccccctccatcgggctgaggaagcacagcagcatcttcaaacatgtacaaaatcgattggctttaaacacccttcacataccctccccccaaattatccccaattatccccacacataaaaaatcaaaacattaaactaacccccttcccccccccccacaacaaccctcttaaaactaattggctttttagaaacaccccacaaaagctcagaaattggctttaaaaaaaacaaccaccaaaaaaaatcaattggctaaaaaaaaaaagtattaaaaacgaattggctgagaaacaattggcaaaataaaggaatttggcactccccacccccctctttctcttctcccttggactttgagtcaaattggcctggacttgagtccctgaaccagcaaagagaaaagaaggaccccagaaatcacaggtgggcacgtcgctgctaccgccatctcccttctcacgggaattttcagggtaaactggccatccgaaaatagcaacaacccagactggctcctcactcccttttccatcactaaaaatcacagagcagtcagagggacccagtaagaccaaaggaggggaggacagagcatgaaaaccaaaatccatgcaaatgaaatgtaattggcacgaccctcacccccaaatcttacatctcaattcccatcctaaaaagcactcatactttatgcatccccgcagctacacacacacaacacacagcacacgcatgaacacagcacacacacgagcacagcacacacacaaacgcacagcacacacagcacacagatgagcacacagcacacacacaaacgcacagcacacacacgcacacacatgcacacacagcacacaaacgcacggcacacacacgcacacacatgcacacacagcacacacacaaacgcacagcacacacaaacgcacagcacacacgcacacacagcacacacacgagcacacagcacacaaacgcacagcacacgcacacacatgcacacacagcacacacactagcacacagcacacacacaaagacacagcacacacatgcacacacagcacacacacgcgaacacagcacacacgaacacagcacacacagcacacacacaaacacagcacacacatgcacacagcacacgcacacacagcacacacatgaacacagcacacagcacacacatgcacacacagcacacacgcatgcacagcacacatgaacacagcacacacacaaacacacagcacacacatgcacacacagcacacacactcatgcgcagcacatacatgaacacagctcacagcacacaaacacgcagcacacacgttgcacacgcaagcacccacctgcacacacacatgcgcacacacacgcacacccccacaaaattggatgaaaacaataagcatatctaagcaactacgatatctgtatggatcaggccaaagtcccgctaagattctccaatgttttcatggtctgagccccgctcctgttcccatctccactgcccctcggccctgtctgtgccctgcctctcagaggagggggctcagatggtgcggcctgagtgtgcggccggcggcatttgggatacacccgtagggtgggcggggtgtgtcccaggcctaattccatctttccaccatgacagagatgcccttgtgaggctggcctccttggcgcctgtccccacggcccccgcagcgtgagccacgatgctccccataccccacccattcccgatacaccttacttactgtgtgttggcccagccagagtgaggaaggagtttggccacattggagatggcggtagctgagcagacatgcccccacgagtagcctgactccctggtgtgctcctggaaggaagatcttggggacccccccaccggagcacacctagggatcatctttgcccgtctcctggggaccccccaagaaatgtggagtcctcgggggccgtgcactgatgcggggagtgtgggaagtctggcggttggaggggtgggtggggggcagtgggggctgggcggggggagttctggggtaggaagtggtcccgggagattttggatggaaaagtcaggaggattgacagcagacttgcagaattacatagagaaattaggaacccccaaatttcatgtcaattgatctattccccctctttgtttcttggggcatttttccttttttttttttttttgttttttttttacccctccttagctttatgcgctcagaaaccaaattaaaccccccccccatgtaacaggggggcagtgacaaaagcaagaacgcacgaagccagcctggagaccaccacgtcctgccccccgccatttatcgccctgattggattttgtttttcatctgtccctgttgcttgggttgagttgagggtggagcctcctggggggcactggccactgagcccccttggagaagtcagaggggagtggagaaggccactgtccggcctggcttctggggacagtggctggtccccagaagtcctgagggcggaggggggggttgggcagggtctcctcaggtgtcaggagggtgctcggaggccacaggagggggctcctggctggcctgaggctggccggaggggaaggggctagcaggtgtgtaaacagagggttccatcaggctggggcagggtggccgccttccgcacacttgaggaaccctcccctctccctcggtgacatcttgcccgcccctcagcaccctgccttgtctccaggaggtccgaagctctgtgggacctcttgggggcaaggtggggtgaggccggggagtagggaggtcaggcgggtctgagcccacagagcaggagagctgccaggtctgcccatcgaccaggttgcttgggccccggagcccacgggtctggtgatgccatagcagccaccaccgcggcgcctagggctgcggcagggactcggcctctgggaggtttacctcgcccccacttgtgcccccagctcagcccccctgcacgcagcccgactagcagtctagaggcctgaggcttctgggtcctggtgacggggctggcatgaccccgggggtcgtccatgccagtccgcctcagtcgcagagggtccctcggcaagcgccctgtgagtgggccattcggaacattggacagaagcccaaagagccaaattgtcacaattgtggaacccacattggcctgagatccaaaacgcttcgaggcaccccaaattacctgcccattcgtcaggacacccacccacccagtgttatattctgcctcgccggagtgggtgttcccgggggcacttgccgaccagccccttgcgtccccaggtttgcagctctcccctgggccactaaccatcctggcccgggctgcctgtctgacctccgtgcctagtcgtggctctccatcttgtctcctccccgtgtccccaatgtcttcagtggggggccccctcttgggtcccctcctctgccatcacctgaagacccccacgccaaacactgaatgtcacctgtgcctgccgcctcggtccaccttgcggcccgtgtttgactcaactcaactcctttaacgctaatatttccggcaaaatcccatgcttgggttttgtctttaaccttgtaacgcttgcaatcccaataaagcattaaaagtcatgaaaaaaaaaaaaaaaaaa

SEQ ID NO: 5694 - DNA, 2503 bp, Homo sapiens
aataaatatggagggcagtgtaaagctcagggcccttgtccactagagacaaggtgccctccgaccccttcttccaaatatactcttttgcctcttgtcttttattcccgtgtttgccccctttgttcagtccccctaggtccatgcaggttacatagtggtgccccaaacagtgacagaattgggttctcagcaagtggtgactcagaacagggacgccaaggatgccaacaagtggcgtctgaacacgggacttcgacgatgtgaacaaaaaagatctgctggagcagagaagctgaaattgacaaggcaaacggggaccccaggatgagtctgccggcagcatatataaggcagggactacaggaaatgaaggtgaactcgtggagattttggagagaatttaatgaagaggctgtttaccaaggatctctctctgtctccgaggctggagtgcaatgttgcaatcagggctcactgcagcctcgacctcctgggctcaactgatcttcctaccacagcctcatgagtaactgggactacagatagtatctcatgatatgaatggtcctggatttacttacacatcctccttttgatgagcaaaaagtaaatttttcacagtgatagacatttgtagtgctttttaaaggcactggttctcttggacactgagagacaatttttatttgctgcacgtggaaaggacaacaacatacctggacagaaatgcctcgaggatgtactgaaggcccctctcacttttcacagccataactgtaagtttcctggggcctctccagaagacaagcagatgccgctatgcttcctgaacagcccacagaactatgaaaaagttaaggctagacgggtcaagccacttgactgataccacaggtcagagcatacaaaggactcaagatcagactagtaatcaaggaagcgtgttgagccaagtgtacaaattcaacagctgggaaggtattatggggaggtcttgtaacattttattcaggtttccttgaaaagaactgaaaactgatgaaacttttagaccgaatattcctttgaaaacatgaatagaattcatttgctgagaggcatgtattgaaacgtgatatctagtgcatggttatttttcactttctaaattaaactgacatagagagtttgagaaataagtttaagaaatagacatggcttatgattgaaagcacaattttccatctaaatgttggtccgtgttcatctttatctcagttagtagcaacctttgttccgcagcagttgttcgttgattgttatggtctgtcgacagctccagctcgtgccatcttcccaatgtaccaacttctctttctctggtcaggttgtgctgttgcctttgtatgtcttcccacctcatggatgttagtttcattatgagaatattgagaaacagtcttccagtcataaccccactggcttccttttctctgtcacttccaaaccgcaggaccattgctgggcaccatgtctacccacccatgagagttaggaataaacacaaacgagttcaattcagttcagcaaacagttattgtgcatctattttatgccaggaactgcagaaggtgctggggtacaaagtgaagaagataatttgcttggtctcaagggggagctcctggtctaatacccaggctcctataatccctcagcattatcctctccactttgcctgttcccctgttgctcattacctgtgcaaccgctcctccctctctggctcaattcctgcttttcttccctctgttcctttatcctgctagtgtcttccttttcaaccatagccaacactccatcttcaaatgcttagcgatacaacttatacctcaactatctggaaaggctttctgaactaagtaggagaagttgtaaatatttaactttttatttttctaaattatctgattataagcaacagtaaaacaaagatcccatattattatctgcagagttaatttggggacaacagggacctcttagtttttttgattaattttaaacttacttgtaattaattggtagtatatgttacaaaccattaaaaattacttaacagtaatcacttttgaaaataggaggaaaataaacatttttatggcagatttgtttgccttaagaattattttgaaagaagtattagaatcgaggcttagaaaaacggtagagtgcttggctgggcgcagtggctcacacctgtaatcccagcactttgggaggccgaggtggatggatcacgaggtcaggagttcgagaccagcctgcccaatatggtgaaaccctgtctctactaaaagtacaaaaattagccgggcgtggtggcgcacgcctgtagtcccagctactcaggaggctgaggaagatcacttgaacccgggaggcagaggttgcagtgagccaagattgtgccactgcactgcaggctgggtgacagagtgagactccatctcaaaaaaac
